US009220926B2

(12) United States Patent
Cotsarelis et al.

(10) Patent No.: US 9,220,926 B2
(45) Date of Patent: Dec. 29, 2015

(54) METHODS FOR GENERATING NEW HAIR FOLLICLES, TREATING BALDNESS, AND HAIR REMOVAL

(75) Inventors: George Cotsarelis, Berwyn, PA (US); Mayumi Ito, Philadelphia, PA (US)

(73) Assignee: THE TRUSTEES OF THE UNIVERSITY OF PENNSYLVANIA, Philadelphia, PA (US)

( * ) Notice: Subject to any disclaimer, the term of this patent is extended or adjusted under 35 U.S.C. 154(b) by 323 days.

(21) Appl. No.: 13/327,611

(22) Filed: Dec. 15, 2011

(65) Prior Publication Data

US 2012/0121693 A1 May 17, 2012

Related U.S. Application Data

(63) Continuation of application No. 11/887,104, filed as application No. PCT/US2006/011319 on Mar. 28, 2006, now abandoned.

(60) Provisional application No. 60/665,857, filed on Mar. 29, 2005, provisional application No. 60/683,293, filed on May 23, 2005.

(51) Int. Cl.
| | |
|---|---|
| *A61Q 7/00* | (2006.01) |
| *A61Q 5/10* | (2006.01) |
| *A61K 8/65* | (2006.01) |
| *A61Q 5/00* | (2006.01) |
| A61B 17/00 | (2006.01) |
| A61B 18/00 | (2006.01) |

(52) U.S. Cl.
CPC ... *A61Q 5/10* (2013.01); *A61K 8/65* (2013.01); *A61Q 5/00* (2013.01); *A61Q 7/00* (2013.01); *A61B 2017/00765* (2013.01); *A61B 2018/00452* (2013.01)

(58) Field of Classification Search
CPC ..... A61N 5/0617; A61Q 7/00; A61B 18/203; A61B 2018/00452; A61B 2018/00476; A61B 2017/00765
See application file for complete search history.

(56) References Cited

U.S. PATENT DOCUMENTS

| | | | |
|---|---|---|---|
| 4,490,365 A | 12/1984 | Panaretto et al. | |
| 4,919,664 A | 4/1990 | Oliver et al. | |
| 5,466,695 A | 11/1995 | Poulos et al. | |
| 6,075,005 A * | 6/2000 | Lurie | 514/9.7 |
| 6,159,950 A * | 12/2000 | Crystal et al. | 514/44 R |
| 6,936,044 B2 | 8/2005 | McDaniel | |
| 2002/0065314 A1 | 5/2002 | Nielsen et al. | |
| 2002/0114772 A1 | 8/2002 | Morgan et al. | |
| 2002/0132792 A1 | 9/2002 | Prien et al. | |
| 2004/0153131 A1 | 8/2004 | Yorke | |
| 2005/0049625 A1 | 3/2005 | Shaya et al. | |
| 2006/0008505 A1 | 1/2006 | Brandon et al. | |
| 2006/0073117 A1 * | 4/2006 | Li | 424/93.1 |
| 2006/0287385 A1 | 12/2006 | Baxter et al. | |
| 2007/0190075 A1 | 8/2007 | Suzuki et al. | |
| 2008/0182859 A1 | 7/2008 | Brunton et al. | |
| 2008/0193423 A1 | 8/2008 | Brunton et al. | |
| 2011/0086007 A1 | 4/2011 | Kemp et al. | |

FOREIGN PATENT DOCUMENTS

| | | |
|---|---|---|
| JP | 2003-081866 A | 3/2003 |
| WO | WO 99/01034 | 1/1999 |
| WO | WO 00/31134 | 6/2000 |
| WO | WO 01/32840 | 5/2001 |
| WO | WO 01/58413 | 8/2001 |
| WO | WO 01/74164 | 10/2001 |
| WO | WO 02/060396 | 8/2002 |
| WO | WO 02/092771 | 11/2002 |
| WO | WO 03/039478 | 5/2003 |
| WO | WO 03/068248 | 8/2003 |
| WO | WO 2004/043415 | 5/2004 |
| WO | WO 2005/017107 | 2/2005 |
| WO | WO 2010/056759 | 5/2010 |

OTHER PUBLICATIONS

Ito et al., 2004, Differentiation 72:548-557.*
Buckland et al., British Medical Journal 296:1645 (1986).*
McElwee et al., J. Clin. Invest. 121:1267-1275 (2003).*
Li Y et al. "Early epidermal destruction with subsequent epidermal hyperplasia is a unique feature of the papilloma-independent squamous cell carcinoma phenotype in PKCepsilon overexpressing transgenic mice" Toxicol Pathol ;33(6):684-94, (2005).
Ley et al. "Hair growth induction by ultraviolet radiation in the marsupial Monodelphis domestica" Arch Dermatol. ;123(8):1032-5, Aug. 1987.
Argyirs T. "Kinetics of epidermal production during epidermal regeneration following abrasion in mice" Am J Pathol. 83(2):329-40, May 1976.
Du Cros. "Fibroblast Growth Factor and Epidermal Growth Factor in Hair Development" Journal Invest Dermatol., vol. 101, pp. 106S-113S, (1993).
Lo Celso et al. "Transient activation of beta-catenin signalling in adult mouse epidermis is sufficient to induce new hair follicles but continuous activation is required to maintain hair follicle tumours" Development, vol. 131, pp. 1787-1799, (2004).
Mater et al., Transient Activation of β-Catenin Signaling in Cutaneous Keratinocytes is Sufficient to Trigger the Active Growth Phase of the Hair Cycle in Mice, Genes and Development, 2003, vol. 17, pp. 1219-1224.
Botchkarev VA et al. "Edar signaling in the control of hair follicle development" J Investig Dermatol Symp Proc. ;10(3):247-51, Dec. 2005.

(Continued)

*Primary Examiner* — Daniel C Gamett
(74) *Attorney, Agent, or Firm* — Mark S. Cohen; Pearl Cohen Zedek Latzer Baratz LLP

(57) ABSTRACT

The present invention provides methods of treating baldness in a subject and generating new hair follicles, comprising epidermal disruption and administration of a compound that promotes a differentiation of an uncommitted epidermal cell into a hair follicle cell. The present invention also provides methods for hair removal and inducing hair pigmentation.

33 Claims, 43 Drawing Sheets

(56) References Cited

OTHER PUBLICATIONS

Fuchs E et al. "Stem cells A new lease on life" Cell. 7;100(1):143-55, Jan. 2000.

Joerg Huelsken et al. "β-Catenin Controls Hair Follicle Morphogenesis and Stem Cell Differentiation in the Skin" Cell, vol. 105, Issue 4, 533-545, May 18, 2001.

Moore et al. "Epidermal Hyperplasia and wool follicle Repression in sheep Infused with Epidermal growth factor" The Journal of Investigation Dermatology, 84:172-175, (1985).

Millar et al. "molecular Mechanisms Regulating Hair follicle Development" The Journal of Investigation Dermatology 118:216-225, (2002).

International Search Report for International Application No. PCT/US06/11319 Date of Mailing May 28, 2008.

Hallmans et al., Regeneration of Hair Follicles from Experimental Wounds on the Rabbit Ear, Scandinavian Journal of Plastic and Reconstructive Surgery, 1974. vol. 8, No. 3, pp. 207-210.

Jahoda et al., Cellular and Extracelluar Involvement in the Regeneration of the Rat Lower Vibrissa Follicle, Development, 1992, vol. 114, pp. 887-897.

Mattar et al., Inhibition of Epidermal Growth Factor Receptor Tyrosine Kinase Activity by Leflunomide, Federation of European Biochemical Societies, Nov. 1993, vol. 334, No. 2, pp. 161-164.

Mak et al., Epidermal Growth Factor as a Biological Switch in Hair Growth Cycle, The Journal of Biological Chemistry, Jul. 11, 2003, vol. 278, No. 28, pp. 26120-26126.

Danilenko et al., Keratinocyte Growth Factor is an Important Endogenous Mediator of Hair Follicle Growth, Development, and Differentiation, Normalization of the nu/nu Follicular Differentiation Defect and Amelioration of Chemotherapy-Induced Alopecia, American Journal of Pathology, Jul. 1, 1995, vol. 147, No. 147, pp. 145-154.

Srivastava et al., Ectodysplasin-A1 is Sufficient to Rescue Both Hair Growth and Sweat Glands in Tabby Mice, Human Molecular Genetics, 2001, vol. 10, No. 26, pp. 2973-2981.

Han et al., Effect of Minoxidil on Proliferation and Apoptosis in Dermal Papilla Cells of Human Hair Follicle, Journal of Dermatological Science, 2004, vol. 34, pp. 91-98.

Botchkarev et al., Noggin is a Mesenchymally Derived Stimulator of Hair-Follicle Induction, Nature Cell Biology, Jul. 1999, vol. 1, pp. 158-164.

Botchkarev et al., Noggin is Required for Induction of the Hair Follicle Growth Phase in Postnatal Skin, FASEB Journal, 2001, vol. 15., pp. 2205-2214.

Ota et al., Fibroblast Growth Factor 5 Inhibits Hair Growth by Blocking Dermal Papilla Cell Activation, Biochemical and Biophysical Research Communications, 2002, vol. 290, pp. 169-176.

Kashiwagi et al., Specific Inhibition of Hair Follicle Formation by Epidermal Growth Factor in an Organ Culture of Developing Mouse Skin, Developmental Biology, 1997, vol. 189, pp. 22-32.

Mitsuyuki et al., Recent Studies on Mechanism of Hair Loss/Hair Growth and Developing Trend of Hair Growth Drug, 2003, Fragrance Journal, vol. 31, No. 2, pp. 33-40. (English abstract.).

Katsuyuki, Effects of Epidermal Growth Factor and Transforming Growth Factor on Cultured Hair Follicle Cells from Human Scalp, Skin, 1994, vol. 36, No. 2, pp. 125-133. (English abstract.).

Tanabe et al., Basic Technology Meeting of the Japanese Orthopedic Association, Program & Abstract, 2003, vol. 12, p. 118. (English abstract.).

Pestana, a et al. "Effect of ultraviolet light on topical minoxidil-induced hair growth in advanced male pattern baldness". Journal of the American Academy of Dermatology, 1987.vol. 16(5): pp. 971-976.

Argyris et al., "On the mechanism of hair growth stimulation in wound healing", Develop. Biol. 9:230-254, 1964.

Johnson et al., "The effect of plucking hairs during different phases of the follicular cycle", J. Embryol. Exp. Morph. 12: 465-474, 1964.

Kligman et al "Neogenesis of human hair follicles", Ann. NY. Acad. Sci. 83: 507-511, 1959.

Mahe et al., "Pro-inflammatory cytokine cascade in human plucked hair", Skin Pharmacol. 9: 366-375, 1996.

Muller et al., "Hair Neogenesis", J. Invest. Dermatol. 56:1-9, 1971.

Reynolds et al., "Inductive properties of hair follicle cells", Ann. NY Acad. Sci. 642: 226-242, 1991.

Argyris et al., "Factors affecting the stimulation of hair growth during wound healing", Anatomical Record, vol. 142, No. 2, 1962, pp. 139-145.

Breedis et al., "Regeneration of hair follicles and sebaceous glands from the epithelium of scars in the rabbit", Cancer Research, vol. 14, No. 8, 1954, p. 17.

\* cited by examiner

K 17 immuno-stain

Cuticle, cortex : S100A3          IRS, medulla: S100A6

8 weeks old mice (2nd telogen)

A.

AP          K17

B.

WIHN assay: 30 days after wound

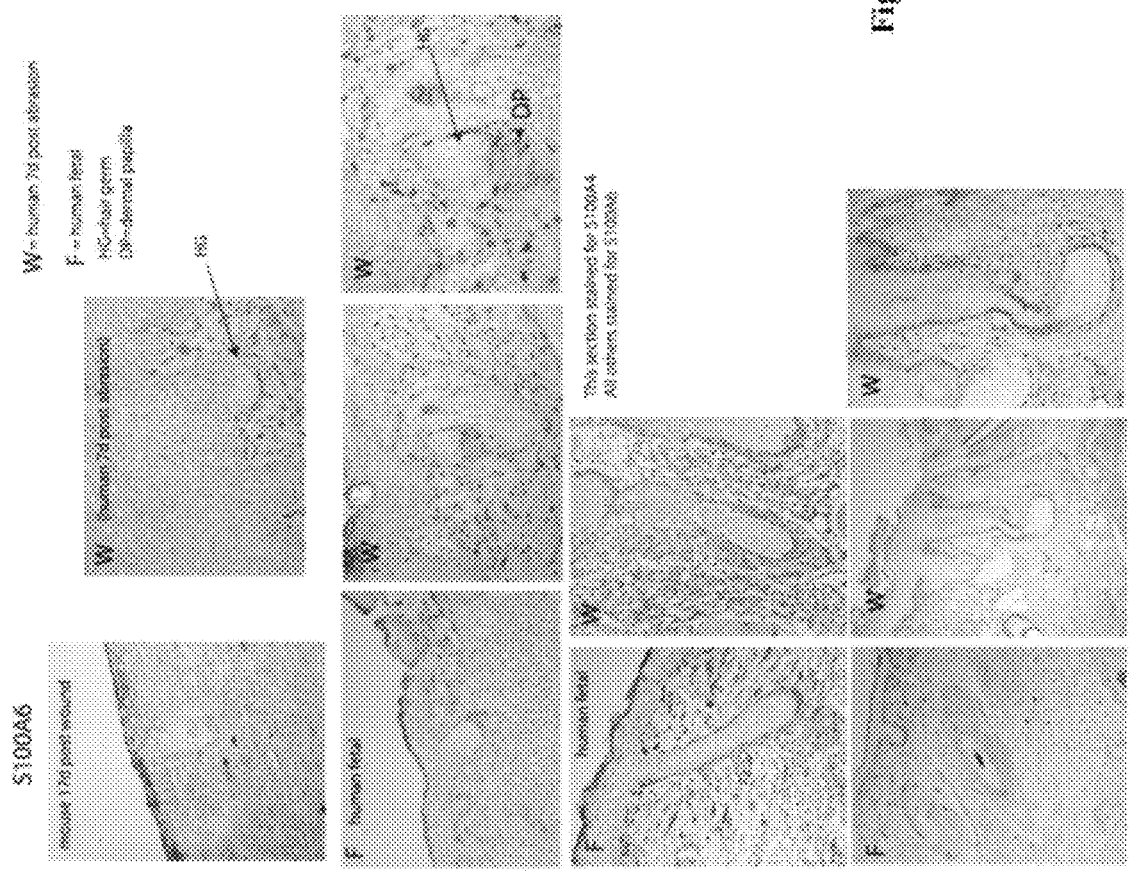

FIGURE 22A

| probe set | SEQ ID No | bs-line mean | bs-line SE | expt mean | expt SE | fold change | lower bound:FC | upper bound:FC | diff. of mean |
|---|---|---|---|---|---|---|---|---|---|
| 160841_at | 1 | -4.59 | 7.45 | 117.99 | 26.88 | 117.99 | 8.2 | 100000000 | 122.57 |
| 103589_at | 2 | -1.28 | 6.58 | 112.41 | 43.53 | 112.41 | 7.13 | 100000000 | 113.68 |
| 103562_f_at | 3 | 23.45 | 12.4 | 220.55 | 110.78 | 9.4 | 1.52 | 75.74 | 197.1 |
| 97527_at | 4 | 27.15 | 14.75 | 173.81 | 24.11 | 6.4 | 3.2 | 60.38 | 146.66 |
| 160909_at | 5 | 115.74 | 46.42 | 706.06 | 192.98 | 6.1 | 2.8 | 18.81 | 590.32 |
| 93285_at | 6 | 132.73 | 53.69 | 782.45 | 138.65 | 5.89 | 3.17 | 17.98 | 649.72 |
| 98988_at | 7 | 119.09 | 33.93 | 650.75 | 97.47 | 5.46 | 3.38 | 10.62 | 531.65 |
| 161903_f_at | 8 | 33.82 | 7.85 | 183.08 | 42.87 | 5.41 | 3.03 | 9.65 | 149.26 |
| 97542_at | 9 | 199 | 149.69 | 1009.76 | 317.31 | 5.07 | 1.71 | 100000000 | 810.76 |
| 104701_at | 10 | 181.01 | 54.87 | 893.77 | 110.08 | 4.94 | 3.1 | 10.04 | 712.76 |
| 94057_g_at | 11 | 194.15 | 36.67 | 895.05 | 169.8 | 4.61 | 2.91 | 7.29 | 700.89 |
| 160092_at | 12 | 142.8 | 67.19 | 637.32 | 153.3 | 4.46 | 2.08 | 20.18 | 494.52 |
| 93527_at | 13 | 55.64 | 18 | 246.09 | 25.21 | 4.42 | 2.77 | 9.57 | 190.46 |
| 92978_s_at | 14 | 208.74 | 82.76 | 904.6 | 260.29 | 4.33 | 1.93 | 13.15 | 695.86 |
| 93985_at | 15 | 117.48 | 43.72 | 505.43 | 102.78 | 4.3 | 2.29 | 11.47 | 387.95 |
| 97197_r_at | 16 | 238.01 | 60.95 | 975.35 | 226.41 | 4.1 | 2.27 | 7.7 | 737.34 |
| 160606_r_at | 17 | 105.16 | 32.48 | 420.67 | 154.57 | 4 | 1.47 | 9.32 | 315.51 |
| 92925_at | 18 | 257.38 | 102.47 | 1023.17 | 152.45 | 3.98 | 2.22 | 11.7 | 765.8 |
| 99849_at | 19 | 611.78 | 159.55 | 2401.77 | 484.37 | 3.93 | 2.29 | 7.33 | 1790 |
| 96295_at | 20 | 147.89 | 44.65 | 548.52 | 112.75 | 3.71 | 2.08 | 7.76 | 400.63 |
| 101554_at | 21 | 561.24 | 162.46 | 1994.33 | 289.7 | 3.55 | 2.2 | 6.99 | 1433.09 |
| 101964_at | 22 | 136.06 | 40.77 | 481.38 | 53.63 | 3.54 | 2.25 | 7.09 | 345.33 |
| 93974_at | 23 | 129.04 | 15.59 | 454.75 | 88.15 | 3.52 | 2.31 | 5.03 | 325.71 |
| 93573_at | 24 | 705.68 | 193.8 | 2449.83 | 87.02 | 3.47 | 2.38 | 6.34 | 1744.15 |
| 162206_f_at | 25 | 283.3 | 111.46 | 948.01 | 188.26 | 3.35 | 1.77 | 9.75 | 664.71 |
| 94056_at | 26 | 380.59 | 72.3 | 1264.27 | 225.61 | 3.32 | 2.14 | 5.22 | 883.68 |
| 101019_at | 27 | 50.97 | 13.15 | 169.04 | 59.25 | 3.32 | 1.32 | 6.77 | 118.07 |
| 160894_at | 28 | 234.87 | 60.8 | 773.72 | 130.11 | 3.29 | 2.04 | 6.01 | 538.85 |
| 102363_r_at | 29 | 483.67 | 195.98 | 1579.93 | 198.13 | 3.27 | 1.86 | 9.9 | 1096.27 |
| 104156_r_at | 30 | 461.52 | 147.14 | 1505.8 | 282.6 | 3.26 | 1.86 | 7.14 | 1044.27 |
| 98083_at | 31 | 265.71 | 64.72 | 829.49 | 157.14 | 3.12 | 1.89 | 5.55 | 563.79 |
| 98589_at | 32 | 237.6 | 42.69 | 733.9 | 54.22 | 3.09 | 2.31 | 4.46 | 496.3 |

FIGURE 22A (continued)

| | | | | | | | | |
|---|---|---|---|---|---|---|---|---|
| 101410_at | 33 | 77.22 | 17.11 | 236.17 | 12.53 | 3.06 | 2.21 | 4.84 | 158.95 |
| 102362_i_at | 34 | 590.2 | 219.11 | 1763.85 | 203.43 | 2.99 | 1.77 | 7.76 | 1173.65 |
| 102955_at | 35 | 126.89 | 27.41 | 378.95 | 95.38 | 2.99 | 1.62 | 5.21 | 252.05 |
| 96657_at | 36 | 202.33 | 31.51 | 593.78 | 96.07 | 2.93 | 2 | 4.28 | 391.45 |
| 92232_at | 37 | 318.7 | 94.52 | 932.68 | 64.57 | 2.93 | 1.93 | 5.75 | 613.99 |
| 99457_at | 38 | 70.6 | 9.12 | 200.86 | 50.21 | 2.85 | 1.63 | 4.33 | 130.26 |
| 103665_at | 39 | 137.79 | 18.28 | 391.39 | 104.78 | 2.84 | 1.55 | 4.42 | 253.6 |
| 104149_at | 40 | 593.93 | 166.71 | 1682.3 | 182.25 | 2.83 | 1.84 | 5.36 | 1088.37 |
| 92730_at | 41 | 221.49 | 83.2 | 627.03 | 101.25 | 2.83 | 1.59 | 7.57 | 405.54 |
| 93346_at | 42 | 149.96 | 31.14 | 421.18 | 85.61 | 2.81 | 1.7 | 4.66 | 271.23 |
| 95439_at | 43 | 88.13 | 19 | 245.95 | 59.22 | 2.79 | 1.56 | 4.83 | 157.82 |
| 102049_at | 44 | 94.74 | 20.76 | 262.21 | 46.03 | 2.77 | 1.75 | 4.61 | 167.47 |
| 97909_at | 45 | 249.59 | 47.89 | 689.01 | 94.06 | 2.76 | 1.9 | 4.23 | 439.41 |
| 97546_at | 46 | 133.71 | 39.2 | 365.48 | 46.12 | 2.73 | 1.73 | 5.4 | 231.77 |
| 98829_at | 47 | 470.98 | 294.77 | 1272.68 | 140.61 | 2.7 | 1.29 | 100000000 | 801.7 |
| 160834_at | 48 | 141.39 | 33.56 | 380.2 | 57.73 | 2.69 | 1.74 | 4.61 | 238.81 |
| 99076_at | 49 | 76.48 | 15.08 | 204.33 | 17.28 | 2.67 | 1.94 | 4.03 | 127.85 |
| 102791_at | 50 | 103.99 | 28.25 | 276.51 | 56.18 | 2.66 | 1.54 | 5.11 | 172.52 |
| 99548_at | 51 | 304.99 | 77.26 | 808.21 | 116.83 | 2.65 | 1.7 | 4.71 | 503.23 |
| 160273_at | 52 | 666.44 | 103.7 | 1761.34 | 209.34 | 2.64 | 1.93 | 3.73 | 1094.9 |
| 101487_f_at | 53 | 394.46 | 67.78 | 1039.29 | 199.81 | 2.63 | 1.68 | 4.05 | 644.83 |
| 104712_at | 54 | 163.95 | 30.93 | 426.88 | 44.04 | 2.6 | 1.87 | 3.89 | 262.93 |
| 98469_at | 55 | 68.51 | 16.59 | 178.35 | 23.69 | 2.6 | 1.71 | 4.47 | 109.84 |
| 93058_at | 56 | 79.66 | 9.53 | 206.19 | 32.24 | 2.59 | 1.83 | 3.55 | 126.53 |
| 95348_at | 57 | 113.11 | 26.29 | 291.76 | 31.62 | 2.58 | 1.76 | 4.28 | 178.65 |
| 98627_at | 58 | 75.74 | 13.15 | 192.98 | 18.48 | 2.55 | 1.88 | 3.67 | 117.24 |
| 103905_at | 59 | 85.15 | 18.59 | 216.11 | 31.03 | 2.54 | 1.69 | 4.14 | 130.96 |
| 96704_at | 60 | 1004.68 | 292.32 | 2541.06 | 64.9 | 2.53 | 1.71 | 4.86 | 1536.38 |
| 96841_at | 61 | 148.26 | 37.17 | 373.77 | 37.64 | 2.52 | 1.7 | 4.37 | 225.51 |
| 93528_s_at | 62 | 325.47 | 42.91 | 814.6 | 94.75 | 2.5 | 1.87 | 3.38 | 489.14 |
| 103995_at | 63 | 99.71 | 18.04 | 245.79 | 64.04 | 2.47 | 1.34 | 4.07 | 146.08 |
| 93619_at | 64 | 211.26 | 36.62 | 518.24 | 59.87 | 2.45 | 1.77 | 3.57 | 306.98 |
| 99603_g_at | 65 | 189.95 | 54.67 | 464.45 | 56.46 | 2.45 | 1.56 | 4.74 | 274.5 |

FIGURE 22A (continued)

| | | | | | | | | |
|---|---|---|---|---|---|---|---|---|
| 97241_at | 66 | 76.34 | 20.54 | 185.14 | 28.15 | 2.43 | 1.52 | 4.51 | 108.8 |
| 93975_at | 67 | 318.9 | 42.47 | 771.29 | 153.37 | 2.42 | 1.56 | 3.52 | 452.39 |
| 92830_s_at | 68 | 951.79 | 313.65 | 2304.83 | 151.2 | 2.42 | 1.54 | 5.31 | 1353.04 |
| 160359_at | 69 | 125.24 | 14.57 | 301.36 | 29.27 | 2.41 | 1.88 | 3.12 | 176.12 |
| 93250_r_at | 70 | 315.77 | 42.86 | 755.99 | 65.92 | 2.39 | 1.86 | 3.18 | 440.23 |
| 101561_at | 71 | 1691.83 | 299.29 | 3988.08 | 129.84 | 2.36 | 1.81 | 3.34 | 2296.25 |
| 160463_at | 72 | 240.25 | 84.32 | 557.92 | 63.82 | 2.32 | 1.4 | 5.56 | 317.68 |
| 94881_at | 73 | 246.87 | 52.18 | 570.73 | 72.1 | 2.31 | 1.58 | 3.68 | 323.86 |
| 162234_f_at | 74 | 104.55 | 14.78 | 240.86 | 33.15 | 2.3 | 1.66 | 3.22 | 136.31 |
| 92777_at | 75 | 354.22 | 125.82 | 815.02 | 57.76 | 2.3 | 1.43 | 5.56 | 460.8 |
| 97413_at | 76 | 186.46 | 42.02 | 426.43 | 57.65 | 2.29 | 1.53 | 3.78 | 239.97 |
| 93290_at | 77 | 220.69 | 54.35 | 506.12 | 81.35 | 2.29 | 1.45 | 4.04 | 285.43 |
| 93193_at | 78 | 106.8 | 15.31 | 243.51 | 20.34 | 2.28 | 1.76 | 3.07 | 136.71 |
| 160369_at | 79 | 171.88 | 14.05 | 391.54 | 74.72 | 2.28 | 1.53 | 3.11 | 219.66 |
| 102788_s_at | 80 | 202.74 | 39.62 | 459.62 | 105.41 | 2.27 | 1.31 | 3.74 | 256.88 |
| 92862_f_at | 81 | 707.54 | 191.58 | 1602.3 | 269.42 | 2.26 | 1.39 | 4.26 | 894.76 |
| 161666_f_at | 82 | 159.92 | 55.82 | 361.44 | 63.64 | 2.26 | 1.28 | 5.47 | 201.53 |
| 100612_at | 83 | 109.28 | 13.06 | 244.41 | 39.49 | 2.24 | 1.57 | 3.09 | 135.13 |
| 100144_at | 84 | 766.09 | 156.62 | 1706.03 | 266.57 | 2.23 | 1.47 | 3.55 | 939.93 |
| 101065_at | 85 | 328.05 | 58.88 | 730.71 | 145.44 | 2.23 | 1.39 | 3.49 | 402.66 |
| 101876_s_at | 86 | 155.5 | 38.86 | 346.44 | 59.57 | 2.23 | 1.38 | 3.98 | 190.94 |
| 92202_g_at | 87 | 330.57 | 53.31 | 733.66 | 40.66 | 2.22 | 1.72 | 3.05 | 403.09 |
| 102371_at | 88 | 1213.29 | 329.9 | 2695.65 | 108.01 | 2.22 | 1.52 | 4.03 | 1482.37 |
| 103846_at | 89 | 1321.78 | 263.93 | 2925.01 | 471.95 | 2.21 | 1.46 | 3.51 | 1603.23 |
| 94375_at | 90 | 146.6 | 20.7 | 321.94 | 52.11 | 2.2 | 1.51 | 3.13 | 175.34 |
| 101995_at | 91 | 98.55 | 18.7 | 215.04 | 21.12 | 2.18 | 1.58 | 3.26 | 116.49 |
| 100156_at | 92 | 99.29 | 9.58 | 216.55 | 45.69 | 2.18 | 1.39 | 3.08 | 117.26 |
| 94452_g_at | 93 | 120.03 | 28.17 | 261.62 | 55.25 | 2.18 | 1.28 | 3.85 | 141.58 |
| 94805_f_at | 94 | 694.87 | 148.44 | 1505.05 | 159.22 | 2.17 | 1.51 | 3.43 | 810.19 |
| 94011_at | 95 | 512.81 | 134.05 | 1106.93 | 232.4 | 2.16 | 1.24 | 4.05 | 594.13 |
| 102381_at | 96 | 135.96 | 23.62 | 291.09 | 59.57 | 2.14 | 1.33 | 3.34 | 155.12 |
| 160617_at | 97 | 202.28 | 37.36 | 430.01 | 58.22 | 2.13 | 1.47 | 3.21 | 227.74 |
| 94246_at | 98 | 466.99 | 78.37 | 985.61 | 170.81 | 2.11 | 1.4 | 3.17 | 518.61 |

FIGURE 22A (continued)

| | | | | | | | | |
|---|---|---|---|---|---|---|---|---|
| 101658_f_at | 99 | 285.59 | 88.76 | 603.43 | 91.07 | 2.11 | 1.28 | 4.44 | 317.83 |
| 160651_at | 100 | 451.96 | 149.58 | 951.74 | 153.08 | 2.11 | 1.23 | 4.75 | 499.78 |
| 99835_at | 101 | 126.74 | 16.43 | 265.21 | 28.87 | 2.09 | 1.59 | 2.8 | 138.46 |
| 94384_at | 102 | 744.33 | 121.74 | 1547.75 | 85.27 | 2.08 | 1.61 | 2.88 | 803.42 |
| 99602_at | 103 | 331.17 | 83.9 | 684.41 | 59.53 | 2.07 | 1.41 | 3.59 | 353.24 |
| 93970_at | 104 | 107.79 | 18.66 | 223.33 | 41.74 | 2.07 | 1.33 | 3.18 | 115.53 |
| 94325_at | 105 | 345.93 | 53.16 | 716.7 | 145.74 | 2.07 | 1.3 | 3.12 | 370.77 |
| 102161_f_at | 106 | 714.47 | 196.16 | 1476.07 | 225.27 | 2.07 | 1.29 | 3.9 | 761.6 |
| 99378_f_at | 107 | 649.9 | 166.98 | 1346.61 | 258.64 | 2.07 | 1.23 | 3.81 | 696.72 |
| 100633_at | 108 | 203.48 | 33.65 | 416.96 | 46.25 | 2.05 | 1.5 | 2.93 | 213.48 |
| 92205_at | 109 | 187.34 | 23.61 | 383.05 | 29.19 | 2.04 | 1.62 | 2.65 | 195.7 |
| 98507_at | 110 | 210.52 | 28.44 | 427.41 | 62.39 | 2.03 | 1.45 | 2.82 | 216.88 |
| 94967_at | 111 | 105.62 | 17.9 | 214.5 | 28.22 | 2.03 | 1.44 | 2.97 | 108.88 |
| 160237_at | 112 | 135.67 | 34.39 | 275.02 | 38.2 | 2.03 | 1.31 | 3.6 | 139.35 |
| 98446_s_at | 113 | 141.88 | 41.45 | 287.07 | 41.58 | 2.02 | 1.25 | 4.01 | 145.19 |
| 96926_at | 114 | 144.45 | 27.93 | 290.46 | 15.29 | 2.01 | 1.5 | 2.97 | 146.01 |
| 92845_at | 115 | 170.95 | 17.73 | 342.33 | 49.39 | 2 | 1.47 | 2.66 | 171.38 |
| 100581_at | 116 | 705.51 | 57.45 | 1408.65 | 224.5 | 2 | 1.44 | 2.63 | 703.14 |
| 104480_at | 117 | 184.72 | 13.66 | 369.2 | 61.29 | 2 | 1.43 | 2.63 | 184.47 |
| 96634_at | 118 | 103.53 | 13.51 | 205.16 | 16.27 | 1.98 | 1.56 | 2.6 | 101.63 |
| 94276_at | 119 | 197.58 | 26.99 | 391.41 | 48.86 | 1.98 | 1.46 | 2.71 | 193.84 |
| 95731_at | 120 | 220.03 | 43.23 | 436.14 | 48.05 | 1.98 | 1.4 | 3.02 | 216.12 |
| 98946_at | 121 | 162.82 | 41.36 | 321.71 | 43.79 | 1.98 | 1.28 | 3.51 | 158.89 |
| 92855_at | 122 | 584.64 | 123.66 | 1154.24 | 120.73 | 1.97 | 1.38 | 3.11 | 569.6 |
| 98545_at | 123 | 237.76 | 53.22 | 464.91 | 55.5 | 1.96 | 1.33 | 3.19 | 227.15 |
| 92625_at | 124 | 397.13 | 83.29 | 780.25 | 118.82 | 1.96 | 1.3 | 3.16 | 383.12 |
| 100618_f_at | 125 | 737.43 | 221.94 | 1443.15 | 153.88 | 1.96 | 1.25 | 3.93 | 705.72 |
| 97826_at | 126 | 831.97 | 82.48 | 1620.67 | 288.56 | 1.95 | 1.34 | 2.67 | 788.7 |
| 96592_at | 127 | 190.99 | 39.76 | 373.19 | 46.44 | 1.95 | 1.34 | 3.08 | 182.19 |
| 95446_at | 128 | 345.12 | 51.28 | 672.7 | 111.59 | 1.95 | 1.33 | 2.82 | 327.59 |
| 93728_at | 129 | 165.51 | 34.39 | 321.77 | 28.72 | 1.94 | 1.39 | 3.01 | 156.26 |
| 103035_at | 130 | 212.61 | 41.86 | 413.17 | 40.37 | 1.94 | 1.39 | 2.95 | 200.56 |
| 102821_s_at | 131 | 332.53 | 54.89 | 646.41 | 115.67 | 1.94 | 1.28 | 2.92 | 313.89 |

FIGURE 22A (continued)

| | | | | | | | | |
|---|---|---|---|---|---|---|---|---|
| 94485_at | 132 | 174.54 | 18.63 | 337.38 | 17.63 | 1.93 | 1.61 | 2.38 | 162.84 |
| 96041_at | 133 | 581.54 | 85.07 | 1124.91 | 148.43 | 1.93 | 1.4 | 2.71 | 543.37 |
| 94526_at | 134 | 119.03 | 10.37 | 229.15 | 35.02 | 1.93 | 1.4 | 2.53 | 110.12 |
| 102121_f_at | 135 | 203.34 | 36.01 | 393.38 | 52.67 | 1.93 | 1.35 | 2.87 | 190.03 |
| 101502_at | 136 | 227.82 | 30.05 | 439.1 | 70.68 | 1.93 | 1.34 | 2.71 | 211.29 |
| 160253_at | 137 | 559.17 | 112.52 | 1080.53 | 208.1 | 1.93 | 1.2 | 3.14 | 521.36 |
| 93833_s_at | 138 | 118.76 | 25.65 | 228.26 | 30.94 | 1.92 | 1.29 | 3.11 | 109.51 |
| 97890_at | 139 | 886.59 | 114.32 | 1689.19 | 208.5 | 1.91 | 1.42 | 2.57 | 802.6 |
| 92578_at | 140 | 167.52 | 26.78 | 319.95 | 49.6 | 1.91 | 1.31 | 2.79 | 152.43 |
| 96357_at | 141 | 208.53 | 27.17 | 398.66 | 67.01 | 1.91 | 1.31 | 2.69 | 190.13 |
| 95514_at | 142 | 164.5 | 28.56 | 311.09 | 31.76 | 1.89 | 1.38 | 2.73 | 146.59 |
| 93738_at | 143 | 135.63 | 16.76 | 256.05 | 38.57 | 1.89 | 1.35 | 2.59 | 120.42 |
| 92848_at | 144 | 329.18 | 59.95 | 621.01 | 79.59 | 1.89 | 1.32 | 2.82 | 291.83 |
| 97819_at | 145 | 417.76 | 74.71 | 789.92 | 105.09 | 1.89 | 1.32 | 2.82 | 372.16 |
| 103736_at | 146 | 124.32 | 15.56 | 234.82 | 40.52 | 1.89 | 1.29 | 2.65 | 110.49 |
| 103015_at | 147 | 302.46 | 28.21 | 568.15 | 94.81 | 1.88 | 1.32 | 2.52 | 265.69 |
| 101954_at | 148 | 499.7 | 65.21 | 941.2 | 170.98 | 1.88 | 1.26 | 2.69 | 441.5 |
| 97914_at | 149 | 239.83 | 28.01 | 448.44 | 80.3 | 1.87 | 1.27 | 2.62 | 208.61 |
| 103990_at | 150 | 1427.05 | 431.41 | 2668.76 | 224.52 | 1.87 | 1.21 | 3.76 | 1241.72 |
| 94448_at | 151 | 235 | 27.61 | 436.14 | 53.8 | 1.86 | 1.39 | 2.46 | 201.14 |
| 101589_at | 152 | 314.4 | 38.1 | 582.39 | 71.53 | 1.85 | 1.39 | 2.47 | 267.99 |
| 93844_at | 153 | 321.51 | 64.32 | 596.1 | 69.34 | 1.85 | 1.3 | 2.86 | 274.59 |
| 94837_at | 154 | 388.4 | 69.03 | 718.72 | 96.69 | 1.85 | 1.29 | 2.75 | 330.32 |
| 160415_at | 155 | 424.11 | 58.34 | 778.3 | 86.16 | 1.84 | 1.38 | 2.49 | 354.18 |
| 93581_at | 156 | 203.54 | 51.74 | 373.94 | 25.84 | 1.84 | 1.27 | 3.19 | 170.4 |
| 96866_at | 157 | 176.53 | 22.06 | 323.63 | 37.09 | 1.83 | 1.39 | 2.44 | 147.1 |
| 97456_at | 158 | 213.02 | 29.46 | 390.07 | 48.64 | 1.83 | 1.35 | 2.52 | 177.05 |
| 95518_at | 159 | 339.31 | 32.71 | 620.19 | 93.36 | 1.83 | 1.33 | 2.42 | 280.88 |
| 99109_at | 160 | 1264.78 | 364.09 | 2315.1 | 123.26 | 1.83 | 1.23 | 3.49 | 1050.32 |
| 92861_i_at | 161 | 752.97 | 134.96 | 1369.66 | 155.42 | 1.82 | 1.31 | 2.68 | 616.69 |
| 98608_at | 162 | 220.94 | 24.33 | 399.97 | 47.71 | 1.81 | 1.38 | 2.37 | 179.03 |
| 93119_at | 163 | 411.82 | 64.25 | 746.17 | 89.81 | 1.81 | 1.32 | 2.56 | 334.36 |
| 104155_f_at | 164 | 1737.95 | 437.64 | 3138.54 | 128.49 | 1.81 | 1.27 | 3.09 | 1400.59 |

FIGURE 22A (continued)

| | | | | | | | | |
|---|---|---|---|---|---|---|---|---|
| 160321_at | 165 | 218.41 | 25.78 | 395.96 | 64.49 | 1.81 | 1.27 | 2.5 | 177.55 |
| 100617_at | 166 | 1161.14 | 143.75 | 2096.53 | 335.8 | 1.81 | 1.26 | 2.5 | 935.39 |
| 103980_at | 167 | 140.65 | 23.54 | 253.19 | 23.59 | 1.8 | 1.34 | 2.56 | 112.54 |
| 94789_r_at | 168 | 601.41 | 109.67 | 1080.26 | 78.55 | 1.8 | 1.34 | 2.61 | 478.85 |
| 99643_f_at | 169 | 319 | 24.89 | 569.9 | 65.84 | 1.79 | 1.4 | 2.23 | 250.9 |
| 99133_at | 170 | 590.99 | 89.73 | 1055.14 | 72.4 | 1.79 | 1.39 | 2.42 | 464.15 |
| 93309_at | 171 | 233.93 | 36.64 | 418.52 | 42.99 | 1.79 | 1.33 | 2.5 | 184.59 |
| 92523_at | 172 | 250.73 | 25.34 | 449.69 | 71.54 | 1.79 | 1.28 | 2.41 | 198.96 |
| 100332_s_at | 173 | 208.03 | 48.17 | 371.64 | 18.02 | 1.79 | 1.28 | 2.9 | 163.61 |
| 160832_at | 174 | 308.34 | 41.38 | 551.8 | 80.83 | 1.79 | 1.27 | 2.49 | 243.46 |
| 103715_at | 175 | 173.45 | 25.07 | 308.76 | 42.06 | 1.78 | 1.28 | 2.49 | 135.31 |
| 93865_s_at | 176 | 169.23 | 21.49 | 299.7 | 39.44 | 1.77 | 1.3 | 2.4 | 130.47 |
| 100557_g_at | 177 | 383.54 | 88.02 | 679.22 | 63.17 | 1.77 | 1.23 | 2.9 | 295.69 |
| 93753_at | 178 | 360.92 | 31.33 | 633.75 | 85.9 | 1.76 | 1.32 | 2.26 | 272.82 |
| 92562_at | 179 | 207.67 | 23.98 | 366.25 | 58.35 | 1.76 | 1.24 | 2.41 | 158.58 |
| 92829_at | 180 | 489.72 | 42 | 854.63 | 124.19 | 1.75 | 1.29 | 2.27 | 364.91 |
| 104410_at | 181 | 246.52 | 31.44 | 430.65 | 61.19 | 1.75 | 1.26 | 2.39 | 184.13 |
| 99106_at | 182 | 144.13 | 12.82 | 252.81 | 42.37 | 1.75 | 1.24 | 2.35 | 108.68 |
| 98059_s_at | 183 | 1207.59 | 325.93 | 2116.17 | 106.63 | 1.75 | 1.2 | 3.16 | 908.58 |
| 160383_at | 184 | 362.28 | 56 | 631.49 | 47.87 | 1.74 | 1.34 | 2.39 | 269.21 |
| 92986_g_at | 185 | 166.57 | 14.19 | 290.15 | 37.21 | 1.74 | 1.33 | 2.22 | 123.57 |
| 93104_at | 186 | 542.76 | 93.36 | 945.49 | 92.87 | 1.74 | 1.28 | 2.5 | 402.74 |
| 95697_at | 187 | 635.08 | 135.07 | 1103.54 | 97.58 | 1.74 | 1.24 | 2.72 | 468.47 |
| 96258_at | 188 | 211.85 | 36.09 | 365.74 | 32.96 | 1.73 | 1.28 | 2.46 | 153.89 |
| 94806_at | 189 | 218.46 | 32.82 | 378.12 | 46.11 | 1.73 | 1.26 | 2.42 | 159.66 |
| 96899_at | 190 | 178.06 | 30.62 | 308.09 | 36.14 | 1.73 | 1.24 | 2.52 | 130.03 |
| 97751_f_at | 191 | 658.6 | 107.19 | 1141.8 | 151.91 | 1.73 | 1.23 | 2.5 | 483.2 |
| 93277_at | 192 | 505.99 | 44.71 | 874.53 | 145.9 | 1.73 | 1.22 | 2.31 | 368.54 |
| 101214_f_at | 193 | 685.55 | 109.92 | 1182.57 | 109.46 | 1.72 | 1.29 | 2.41 | 497.02 |
| 100595_at | 194 | 237.36 | 25.26 | 407.84 | 55.12 | 1.72 | 1.28 | 2.27 | 170.47 |
| 98472_at | 195 | 651.55 | 118.79 | 1119.49 | 134.47 | 1.72 | 1.22 | 2.56 | 467.94 |
| 101989_at | 196 | 570.91 | 114.95 | 974.97 | 77.6 | 1.71 | 1.24 | 2.6 | 404.06 |
| 93029_at | 197 | 187.78 | 36.47 | 321.07 | 37.75 | 1.71 | 1.2 | 2.61 | 133.29 |

FIGURE 22A (continued)

| | | | | | | | | |
|---|---|---|---|---|---|---|---|---|
| 96353_at | 198 | 171.48 | 29.57 | 291.99 | 26.09 1.7 | 1.27 | 2.44 | 120.52 |
| 99642_i_at | 199 | 290.17 | 36.11 | 492.69 | 65.91 1.7 | 1.25 | 2.3 | 202.52 |
| 98505_i_at | 200 | 276.98 | 10.47 | 471.34 | 79.76 1.7 | 1.22 | 2.19 | 194.37 |
| 93818_g_at | 201 | 365.43 | 53.8 | 615.41 | 50.44 1.68 | 1.3 | 2.28 | 249.98 |
| 94489_at | 202 | 678.41 | 80.48 | 1140.47 | 120.27 1.68 | 1.3 | 2.2 | 462.07 |
| 98447_at | 203 | 474.58 | 68.17 | 797.13 | 65.87 1.68 | 1.3 | 2.26 | 322.55 |
| 101906_at | 204 | 195.27 | 13.72 | 328.07 | 43.2 1.68 | 1.29 | 2.12 | 132.79 |
| 100599_at | 205 | 590.8 | 50.09 | 988.25 | 112.1 1.67 | 1.31 | 2.1 | 397.45 |
| 94062_at | 206 | 293.1 | 32.58 | 485.75 | 61.45 1.66 | 1.24 | 2.19 | 192.66 |
| 97386_at | 207 | 281.32 | 33.9 | 464.62 | 46.81 1.65 | 1.28 | 2.16 | 183.3 |
| 100578_at | 208 | 359.42 | 48.01 | 592.91 | 61.72 1.65 | 1.25 | 2.21 | 233.49 |
| 98438_f_at | 209 | 1400 | 229.84 | 2305.65 | 172.46 1.65 | 1.25 | 2.3 | 905.65 |
| 103612_at | 210 | 586.37 | 64.7 | 961.03 | 78.44 1.64 | 1.31 | 2.08 | 374.66 |
| 160246_at | 211 | 218.98 | 23.47 | 358.79 | 45.78 1.64 | 1.23 | 2.15 | 139.81 |
| 92958_at | 212 | 197.31 | 18.13 | 321.1 | 12.53 1.63 | 1.39 | 1.94 | 123.79 |
| 93023_f_at | 213 | 1289.41 | 185.86 | 2104.73 | 90.02 1.63 | 1.3 | 2.16 | 815.32 |
| 160568_at | 214 | 312.65 | 31.22 | 508.7 | 70.08 1.63 | 1.21 | 2.14 | 196.06 |
| 92816_r_at | 215 | 461.32 | 64.04 | 752.55 | 93.39 1.63 | 1.2 | 2.24 | 291.23 |
| 98937_at | 216 | 195.45 | 27 | 317.11 | 20.14 1.62 | 1.28 | 2.14 | 121.67 |
| 160451_at | 217 | 210.95 | 25.47 | 341.15 | 38.6 1.62 | 1.23 | 2.14 | 130.2 |
| 93714_f_at | 218 | 1503.18 | 228.1 | 2418.85 | 193.58 1.61 | 1.24 | 2.2 | 915.67 |
| 160090_f_at | 219 | 680.13 | 60.49 | 1097.27 | 134.99 1.61 | 1.24 | 2.06 | 417.13 |
| 96755_at | 220 | 262.5 | 36.34 | 420.8 | 38.88 1.6 | 1.23 | 2.15 | 158.3 |
| 93354_at | 221 | 674.48 | 86.44 | 1059.32 | 74.23 1.57 | 1.25 | 2.04 | 384.83 |
| 93071_at | 222 | 434.6 | 69 | 682.99 | 36.08 1.57 | 1.22 | 2.15 | 248.4 |
| 93264_at | 223 | 431.59 | 34.88 | 673.83 | 41.04 1.56 | 1.33 | 1.85 | 242.23 |
| 100128_at | 224 | 247.99 | 29.26 | 385.76 | 26.99 1.56 | 1.25 | 1.98 | 137.77 |
| 93057_at | 225 | 612.72 | 56.09 | 945.97 | 107.03 1.54 | 1.2 | 1.96 | 333.24 |
| 103416_at | 226 | 297.37 | 17.14 | 454.06 | 55.15 1.53 | 1.2 | 1.88 | 156.69 |
| 95069_at | 227 | 204.72 | 17.73 | 310.68 | 31.68 1.52 | 1.21 | 1.89 | 105.96 |
| 93274_at | 228 | 455.45 | 34.85 | 687.58 | 68.3 1.51 | 1.22 | 1.85 | 232.13 |
| 101112_g_at | 229 | 316.94 | 39.38 | 479.63 | 30.55 1.51 | 1.22 | 1.94 | 162.69 |
| 96416_f_at | 230 | 1047.69 | 154.71 | 1580.26 | 36.04 1.51 | 1.21 | 2 | 532.57 |

FIGURE 22A (continued)

| | | | | | | | | |
|---|---|---|---|---|---|---|---|---|
| 96115_at | 231 | 882.18 | 67.27 | 1307.78 | 68.28 | 1.48 | 1.28 | 1.73 | 425.6 |
| 162358_i_at | 232 | 260.46 | 28.47 | 382.39 | 11.42 | 1.47 | 1.23 | 1.8 | 121.92 |

FIGURE 22B

| SEQ ID No | A1- High | A2- ctrl | A3- ctrl | A4- ctrl | High-dep A1 | High_dep A2 | High-dep A4 |
|---|---|---|---|---|---|---|---|
| 1 | -5.63 | -17.67 | -5.17 | 6.77 | 83.12 | 169.99 | 100.58 |
| 2 | -2.54 | -14.06 | 0.94 | 10.82 | 87.42 | 54.4 | 195.99 |
| 3 | 23.31 | 8.36 | 7.01 | 53.96 | 38.68 | 206.2 | 417.26 |
| 4 | 19.77 | 2.26 | 24.49 | 58.97 | 205.62 | 127.45 | 188.14 |
| 5 | 139.28 | 52.41 | 114.17 | 154.8 | 635.16 | 417.84 | 1060.26 |
| 6 | 39.56 | 63.62 | 152.7 | 275.17 | 1060.5 | 629.24 | 658.28 |
| 7 | 110.88 | 59.72 | 89.21 | 214.03 | 726.78 | 468.04 | 764.58 |
| 8 | 32.41 | 21.49 | 24.37 | 54.71 | 255 | 107.37 | 188.45 |
| 9 | 331.43 | -167.33 | 163.29 | 469.3 | 481.09 | 1002.95 | 1554.39 |
| 10 | 116.76 | 108.93 | 156.49 | 342 | 1063.9 | 692.84 | 928.59 |
| 11 | 283.17 | 121.9 | 170.16 | 205.78 | 1011.81 | 567.07 | 1110.23 |
| 12 | 74.97 | 22.58 | 143.49 | 331.85 | 942.05 | 448.77 | 522.72 |
| 13 | 42.96 | 17.71 | 59.52 | 96.43 | 288.14 | 207.6 | 245.94 |
| 14 | 444.42 | 87.63 | 119.71 | 180.16 | 943.76 | 445.53 | 1329.18 |
| 15 | 78.04 | 27.45 | 130.69 | 228.96 | 704.54 | 360.25 | 453.08 |
| 16 | 221.31 | 82.68 | 273.71 | 375.27 | 720.98 | 786.45 | 1419.72 |
| 17 | 68.92 | 41.02 | 121.74 | 188.95 | 730.1 | 262.37 | 269.51 |
| 18 | 129.38 | 43.78 | 378.11 | 479.44 | 1325.48 | 831.71 | 919.9 |
| 19 | 418.78 | 404.48 | 559.46 | 1077.69 | 2507.7 | 1533.6 | 3167.77 |
| 20 | 256.89 | 60.48 | 111.55 | 157.48 | 478.62 | 401.72 | 765.65 |
| 21 | 442.7 | 254.33 | 526.58 | 1016.59 | 2409.26 | 1449.07 | 2138.65 |
| 22 | 114.71 | 44.84 | 149.01 | 227.39 | 581.81 | 403.71 | 464.3 |
| 23 | 140.81 | 93.38 | 119.51 | 155.72 | 371.38 | 380.48 | 623.48 |
| 24 | 720.51 | 156.21 | 941.53 | 1000.88 | 2478.16 | 2355.04 | 2547.28 |
| 25 | 192.27 | 92.36 | 240.88 | 605.76 | 1169.42 | 577.85 | 1099.93 |
| 26 | 580.94 | 313.16 | 283.46 | 347.07 | 1341.64 | 851.31 | 1604.33 |
| 27 | 84.02 | 29.36 | 36.55 | 53.49 | 134.3 | 91.56 | 282.49 |
| 28 | 143.01 | 123.84 | 298.75 | 373.89 | 1005.66 | 557.55 | 761.95 |
| 29 | 320.38 | 113.16 | 481.11 | 1025.22 | 1437.46 | 1952.41 | 1354.26 |
| 30 | 296.03 | 137.39 | 718.51 | 695.82 | 2067.83 | 1311.65 | 1152.53 |
| 31 | 214.27 | 126.62 | 314.52 | 408.07 | 1145.61 | 689.57 | 663.78 |
| 32 | 206.21 | 153.91 | 280.51 | 297.21 | 837.74 | 706.2 | 660.62 |
| 33 | 81.04 | 51.06 | 75.14 | 98.1 | 233.5 | 241.15 | 234.39 |
| 34 | 395.98 | 128.67 | 700.46 | 1145.39 | 1809.54 | 2080.32 | 1412.16 |
| 35 | 65.85 | 99.89 | 157.89 | 185.62 | 569.39 | 266.39 | 301.91 |
| 36 | 263.18 | 139.8 | 182.15 | 218.92 | 598.64 | 431.27 | 753.7 |
| 37 | 177.42 | 150.27 | 399.45 | 540.28 | 983.19 | 832.33 | 997.4 |
| 38 | 74.75 | 74.97 | 48.84 | 82.72 | 182.41 | 128.43 | 293.82 |
| 39 | 150.84 | 95.39 | 167.23 | 138.08 | 392.12 | 214.37 | 570.07 |
| 40 | 540.31 | 300.82 | 465.12 | 1073.48 | 1938.91 | 1348.09 | 1771.76 |
| 41 | 132.57 | 108.3 | 176.91 | 468.34 | 826.57 | 495.76 | 559.84 |
| 42 | 202.76 | 65.77 | 160.86 | 161.92 | 501.64 | 253.72 | 509.75 |
| 43 | 70.65 | 48.97 | 117.21 | 117.12 | 212.32 | 168.69 | 357.86 |
| 44 | 59.89 | 73.74 | 89.86 | 151.61 | 354.26 | 227.02 | 207.74 |
| 45 | 262.7 | 140.08 | 223.83 | 362.92 | 768 | 506.51 | 792.68 |
| 46 | 203.13 | 24.19 | 141.14 | 166.52 | 396.35 | 278.68 | 423.13 |
| 47 | 1249.11 | -163.61 | 288.35 | 509.86 | 1213.24 | 1064.64 | 1540.1 |
| 48 | 112.44 | 70.65 | 156.69 | 225.29 | 470.4 | 278.49 | 398.79 |
| 49 | 78.27 | 43.65 | 67.66 | 114.57 | 215.12 | 174.03 | 225.14 |

FIGURE 22B (continued)

| | | | | | | | |
|---|---|---|---|---|---|---|---|
| 50 | 132.5 | 26.28 | 122.03 | 135.16 | 277.18 | 181.31 | 371.58 |
| 51 | 262.43 | 112.26 | 371.84 | 470.08 | 711.07 | 681.81 | 1033.8 |
| 52 | 536.76 | 461.17 | 769.77 | 889.81 | 1975.05 | 1352.89 | 1960.32 |
| 53 | 438.88 | 225 | 382.84 | 525.6 | 835.86 | 857.62 | 1428.27 |
| 54 | 141.38 | 90.71 | 202.04 | 223.88 | 495.75 | 346.79 | 438.26 |
| 55 | 74.76 | 50.42 | 52.47 | 86.4 | 192.43 | 139.97 | 206.83 |
| 56 | 79.05 | 66.18 | 67.55 | 103.4 | 264.65 | 154.74 | 201.21 |
| 57 | 80.07 | 90.7 | 102.4 | 176.88 | 281.97 | 349.67 | 243.8 |
| 58 | 68.4 | 106.51 | 76.63 | 59.14 | 167.01 | 225.34 | 186.51 |
| 59 | 83.86 | 39.01 | 93.03 | 123.08 | 222.12 | 160.9 | 264.71 |
| 60 | 1296.17 | 167.7 | 1103.2 | 1462.67 | 2516.18 | 2486.75 | 2606.4 |
| 61 | 149.99 | 61.1 | 151.09 | 218.82 | 346.11 | 438.58 | 339.9 |
| 62 | 215.58 | 309.49 | 355.1 | 416.34 | 941.89 | 641.57 | 866.1 |
| 63 | 137.69 | 69.83 | 69.95 | 117.25 | 233.19 | 145.75 | 360.25 |
| 64 | 176.23 | 129.22 | 287.4 | 244.63 | 611.3 | 538.23 | 410.26 |
| 65 | 135.04 | 70.48 | 243.79 | 312.9 | 563.01 | 370.79 | 457.06 |
| 66 | 65.19 | 25.39 | 94.18 | 120.53 | 218.57 | 131.58 | 207.17 |
| 67 | 356.76 | 227.22 | 367.73 | 327.65 | 715.66 | 626.94 | 1034.2 |
| 68 | 643.68 | 299.61 | 1106.73 | 1751.38 | 2438.92 | 2465.26 | 2012.95 |
| 69 | 119.23 | 94.41 | 135.34 | 146.07 | 349.59 | 254.82 | 301.39 |
| 70 | 360.47 | 304.94 | 200.13 | 397.18 | 812.63 | 626.76 | 826.71 |
| 71 | 1701.31 | 921.16 | 1800.76 | 2328.77 | 4084.28 | 3803.84 | 4121.35 |
| 72 | 101 | 107.87 | 287.29 | 454.65 | 684.09 | 490.91 | 508.17 |
| 73 | 346.1 | 105.04 | 264.96 | 271.03 | 707.56 | 464.44 | 544.27 |
| 74 | 85.55 | 89.81 | 95.56 | 146.28 | 262.05 | 181.42 | 283.51 |
| 75 | 182.89 | 96.32 | 560.09 | 578.66 | 860.12 | 883.46 | 701.98 |
| 76 | 115.65 | 123.07 | 243.02 | 261.83 | 523.34 | 333.37 | 432.41 |
| 77 | 198.8 | 93.34 | 229.65 | 356.53 | 561.03 | 352.4 | 609.09 |
| 78 | 93.9 | 77.62 | 124.29 | 133.58 | 283.15 | 228.24 | 224.33 |
| 79 | 149.09 | 174.43 | 183.43 | 179 | 525.24 | 268.7 | 384.89 |
| 80 | 163.12 | 123.1 | 266.84 | 253.62 | 470.88 | 274.31 | 633.27 |
| 81 | 511.47 | 273.07 | 950.77 | 1091.08 | 1547.45 | 1179.77 | 2083.79 |
| 82 | 131.81 | 52.72 | 137.49 | 317.72 | 382.99 | 247.01 | 456.6 |
| 83 | 119.97 | 78 | 102.46 | 124.31 | 250.65 | 174.67 | 308.27 |
| 84 | 946.19 | 351.71 | 705.88 | 1059.06 | 1534.13 | 1361.23 | 2222.82 |
| 85 | 298.4 | 248.35 | 262.8 | 500.23 | 730.02 | 490.82 | 977.92 |
| 86 | 126.17 | 60.47 | 225.06 | 210.49 | 298.85 | 278.49 | 462.49 |
| 87 | 204.53 | 399.01 | 430.57 | 291 | 748.26 | 669.68 | 788.41 |
| 88 | 897.74 | 464 | 1566.84 | 1913.81 | 2787.91 | 2754.92 | 2592.71 |
| 89 | 1876.3 | 682.31 | 1158.85 | 1527.08 | 3819.6 | 2224.18 | 2746.01 |
| 90 | 109.7 | 130.79 | 142.04 | 203.42 | 416.8 | 240.51 | 313.38 |
| 91 | 70.83 | 65.03 | 116.01 | 137.3 | 243.19 | 178.45 | 227.11 |
| 92 | 104.22 | 80.52 | 100.91 | 111.37 | 166.84 | 178.35 | 305.19 |
| 93 | 160.76 | 41.21 | 121.95 | 155.07 | 261.42 | 168.61 | 355.69 |
| 94 | 1002.21 | 376.59 | 623.8 | 798.55 | 1496.07 | 1240.29 | 1771.65 |
| 95 | 565.29 | 155.67 | 524.23 | 804.82 | 1036.06 | 747.86 | 1536.56 |
| 96 | 83.36 | 127.14 | 137.58 | 196.8 | 262.3 | 209.25 | 402.22 |
| 97 | 170.87 | 118.9 | 283.84 | 230 | 370.12 | 379.44 | 542.27 |
| 98 | 510.11 | 255.73 | 467.06 | 628.25 | 1295.4 | 706.07 | 958.06 |
| 99 | 460.1 | 53.41 | 304.69 | 327.47 | 443.97 | 628.87 | 737.78 |

FIGURE 22B (continued)

| | | | | | | | |
|---|---|---|---|---|---|---|---|
| 100 | 863.6 | 207.42 | 306.15 | 435.08 | 951.34 | 699.25 | 1208.97 |
| 101 | 115.92 | 128.12 | 128.12 | 137.12 | 321.41 | 245.54 | 230.42 |
| 102 | 609.66 | 500.34 | 785.38 | 1034.85 | 1585.94 | 1451 | 1624.77 |
| 103 | 264.25 | 164.9 | 333.89 | 561.29 | 779.16 | 607.88 | 694.78 |
| 104 | 123.78 | 64.66 | 93.68 | 149.27 | 251.83 | 142.53 | 276.23 |
| 105 | 448.92 | 217.48 | 316.74 | 404.21 | 792.91 | 438.86 | 920.02 |
| 106 | 872.5 | 136.08 | 872.47 | 976.55 | 1308.91 | 1211.31 | 1907.24 |
| 107 | 782.84 | 160.15 | 782.21 | 875.83 | 1103.1 | 1100.16 | 1844.59 |
| 108 | 183.5 | 120.8 | 230.11 | 274.68 | 502.11 | 346.62 | 406.3 |
| 109 | 145.22 | 154.75 | 215.32 | 223.86 | 402.89 | 331.79 | 416.36 |
| 110 | 242.68 | 131.21 | 227.3 | 239.68 | 545.7 | 407.72 | 334.91 |
| 111 | 152.64 | 73.67 | 94.27 | 97.84 | 216.43 | 168.83 | 260.02 |
| 112 | 137.9 | 40.27 | 191.51 | 171.58 | 349.08 | 223.32 | 253.36 |
| 113 | 231.99 | 37.75 | 125.33 | 172.57 | 318.72 | 207 | 336.68 |
| 114 | 129.7 | 79.03 | 166.88 | 193.5 | 277.7 | 286.34 | 305.25 |
| 115 | 151.91 | 143.6 | 165.79 | 218.92 | 406.76 | 248.28 | 374.11 |
| 116 | 688 | 569.04 | 732.38 | 823.68 | 1470.55 | 998.09 | 1757.45 |
| 117 | 177.77 | 181.58 | 163.05 | 216.72 | 349.95 | 275.4 | 480.9 |
| 118 | 67.73 | 111.6 | 121.41 | 116 | 229.84 | 178.33 | 208.33 |
| 119 | 186.4 | 143.44 | 190.67 | 266.45 | 474.16 | 308.84 | 393.31 |
| 120 | 213.57 | 102.11 | 277.63 | 286.81 | 395.79 | 387.24 | 526.05 |
| 121 | 153.49 | 76.2 | 145.61 | 274.72 | 403.36 | 255.75 | 309.24 |
| 122 | 511.99 | 296.95 | 641.95 | 887.33 | 1370.99 | 960.71 | 1133.77 |
| 123 | 255.48 | 96.57 | 246.27 | 353.38 | 455.98 | 376.23 | 562.17 |
| 124 | 519.52 | 161.83 | 403.43 | 502.64 | 902.52 | 546.05 | 893.71 |
| 125 | 1059.81 | 121.89 | 723.62 | 1035.98 | 1346.69 | 1263.28 | 1730.1 |
| 126 | 794.58 | 646.29 | 894.06 | 979.75 | 1585.26 | 1153.91 | 2124.6 |
| 127 | 182.15 | 100.35 | 187.18 | 293.39 | 300.2 | 373.46 | 449.27 |
| 128 | 310.84 | 246.38 | 333.32 | 488.12 | 876.51 | 493.78 | 651.77 |
| 129 | 152.43 | 89.76 | 166.79 | 251.84 | 357.65 | 267 | 340.43 |
| 130 | 207.57 | 100.38 | 282.81 | 259.08 | 456.54 | 335.38 | 446.38 |
| 131 | 455.54 | 202.21 | 301.47 | 370.84 | 756.41 | 417.26 | 766.51 |
| 132 | 145.05 | 144.44 | 187.68 | 216.41 | 338.95 | 310.57 | 362.17 |
| 133 | 554.11 | 402.15 | 567.63 | 809.76 | 1292.17 | 844.8 | 1249.13 |
| 134 | 130.24 | 103.48 | 113.49 | 126.1 | 297.16 | 184.92 | 204.95 |
| 135 | 186.7 | 119.75 | 289.61 | 216.49 | 446.72 | 288.14 | 445.05 |
| 136 | 189.47 | 168.95 | 262.02 | 293.93 | 548.58 | 309.28 | 462.05 |
| 137 | 638.29 | 239.8 | 626.95 | 717.65 | 999.55 | 774.33 | 1465.56 |
| 138 | 124.73 | 52.62 | 119.62 | 177.26 | 234.37 | 175.19 | 275.85 |
| 139 | 829.09 | 706.34 | 788.34 | 1218.18 | 1732 | 1318.01 | 2016.68 |
| 140 | 196.56 | 96.26 | 168.71 | 211.3 | 409.32 | 239.57 | 313.52 |
| 141 | 194.4 | 142.96 | 233.73 | 262.23 | 436.12 | 272.78 | 488.44 |
| 142 | 144.74 | 96.33 | 183.54 | 226.73 | 338.13 | 260.1 | 343.18 |
| 143 | 132.94 | 103.91 | 170.64 | 131.81 | 328.78 | 200.99 | 237.08 |
| 144 | 385.59 | 190.9 | 277.34 | 461.73 | 691.3 | 466.96 | 705.79 |
| 145 | 479.58 | 201.87 | 479.86 | 510.07 | 855.6 | 589.24 | 927.23 |
| 146 | 82.02 | 125.19 | 133.96 | 156.08 | 293.82 | 157.63 | 253.33 |
| 147 | 242.78 | 269.89 | 348.84 | 344.92 | 707.32 | 393.24 | 610.03 |
| 148 | 565.1 | 394.93 | 387.65 | 642.06 | 946.42 | 655.01 | 1228.65 |
| 149 | 275.94 | 169.57 | 227.25 | 286.38 | 493.91 | 297.39 | 557.13 |

FIGURE 22B (continued)

| | | | | | | | |
|---|---|---|---|---|---|---|---|
| 150 | 781.55 | 580.02 | 2127.05 | 2208.06 | 3043.92 | 2702.29 | 2282.46 |
| 151 | 261.4 | 158.9 | 250.2 | 264.02 | 505.64 | 334.83 | 472.08 |
| 152 | 372.91 | 232.5 | 286.71 | 377.42 | 687.16 | 450.09 | 612.82 |
| 153 | 410.42 | 131.97 | 369.05 | 367.78 | 720.73 | 484.99 | 582.85 |
| 154 | 461.07 | 191.03 | 424.7 | 468.61 | 797.92 | 532.2 | 829.45 |
| 155 | 546.5 | 268.31 | 446.34 | 433.67 | 794.32 | 630 | 915.07 |
| 156 | 282.84 | 57.22 | 211.67 | 257.88 | 396.65 | 328.24 | 398.79 |
| 157 | 201.46 | 120.48 | 177.34 | 191.62 | 357.2 | 254.61 | 361.88 |
| 158 | 232.31 | 128.28 | 247.88 | 241.71 | 440.6 | 294.47 | 435.39 |
| 159 | 334.05 | 275.32 | 324.52 | 425.52 | 772.86 | 454.43 | 637.76 |
| 160 | 1051.89 | 397.67 | 1479.38 | 2126.13 | 2268.38 | 2529.2 | 2169.17 |
| 161 | 798.21 | 399.8 | 899.89 | 912.54 | 1287.69 | 1165.36 | 1655.86 |
| 162 | 244.32 | 157.06 | 225.73 | 253.07 | 427.09 | 313.85 | 463.56 |
| 163 | 438.76 | 226.89 | 457.14 | 513.87 | 898.95 | 594.47 | 745.37 |
| 164 | 1352.95 | 718.09 | 2236.02 | 2654.99 | 3278.78 | 3093.26 | 3118.24 |
| 165 | 214.2 | 173.96 | 194.94 | 287.47 | 464.04 | 272.6 | 455.63 |
| 166 | 1255.16 | 786.4 | 1150.85 | 1467.91 | 2159.71 | 1497.04 | 2635.45 |
| 167 | 126.6 | 89.26 | 180.85 | 154.61 | 268.42 | 225.32 | 276.81 |
| 168 | 771.24 | 305.25 | 587.97 | 728 | 1144.4 | 942.94 | 1161.59 |
| 169 | 263.57 | 319.12 | 316.73 | 380.47 | 669.63 | 447.63 | 593.13 |
| 170 | 590.2 | 359.6 | 608.4 | 795.03 | 1151.48 | 940.65 | 1093.9 |
| 171 | 240.81 | 133.89 | 251.93 | 307.57 | 489.86 | 345.71 | 424.47 |
| 172 | 261.55 | 218.92 | 220.14 | 275.29 | 400.11 | 375.64 | 584.55 |
| 173 | 293.62 | 82.87 | 186.43 | 269.33 | 379.84 | 345.41 | 394.6 |
| 174 | 317.27 | 208 | 305.44 | 404.98 | 669.86 | 404.54 | 588.74 |
| 175 | 210.83 | 108.43 | 178.61 | 189.73 | 297.39 | 249.07 | 382.93 |
| 176 | 148.52 | 120.38 | 201.64 | 203.61 | 293.01 | 238.39 | 369.71 |
| 177 | 389.88 | 142.96 | 438.38 | 556.24 | 611.53 | 633.48 | 795.43 |
| 178 | 351.77 | 286.84 | 364.72 | 436.79 | 792.97 | 498.19 | 611.18 |
| 179 | 189.25 | 165.89 | 196.05 | 273.16 | 411.47 | 252.37 | 435.01 |
| 180 | 549.81 | 444.28 | 396.42 | 562.95 | 980.17 | 611.93 | 973.6 |
| 181 | 256.18 | 158.27 | 285.46 | 278.17 | 552.75 | 386.78 | 362.56 |
| 182 | 158.87 | 122.18 | 130.52 | 158.92 | 323.99 | 182.08 | 258.41 |
| 183 | 1266.87 | 291.34 | 1465.85 | 1809.88 | 1981.71 | 2056.61 | 2286.62 |
| 184 | 441.84 | 217.7 | 330.57 | 455.9 | 703.49 | 549.05 | 646.54 |
| 185 | 189.38 | 134.13 | 158.87 | 184.24 | 293.44 | 226.46 | 351.53 |
| 186 | 682.11 | 281.63 | 567.42 | 645.45 | 1043.8 | 769.32 | 1024.99 |
| 187 | 863.99 | 258.52 | 643.98 | 775.24 | 1117.04 | 935.31 | 1259.67 |
| 188 | 250.42 | 107.62 | 249.84 | 237.46 | 404.92 | 391.03 | 300.92 |
| 189 | 268.86 | 131.02 | 211.1 | 263.99 | 412.1 | 289.7 | 433.76 |
| 190 | 202.48 | 88.45 | 208.4 | 211.97 | 366.42 | 245.63 | 315.38 |
| 191 | 763.84 | 372.77 | 638.07 | 864.79 | 1250.89 | 844.06 | 1330.22 |
| 192 | 579.01 | 403.81 | 461.65 | 580.39 | 930.22 | 604.38 | 1090.47 |
| 193 | 759.99 | 385.43 | 693.65 | 904.07 | 1217.27 | 982.86 | 1345.6 |
| 194 | 218.54 | 189.34 | 293.62 | 244.62 | 464.88 | 302.69 | 459.29 |
| 195 | 548.82 | 366.81 | 834.12 | 848.12 | 1219.9 | 862.27 | 1278.38 |
| 196 | 680.15 | 231.09 | 644.14 | 722.42 | 1096.65 | 839.03 | 998.56 |
| 197 | 200.26 | 89.81 | 194.73 | 265.83 | 363.25 | 250.69 | 353.76 |
| 198 | 195.2 | 85.23 | 185.31 | 214.94 | 331.76 | 248.9 | 298.72 |
| 199 | 212 | 250.08 | 339.99 | 361.59 | 598.36 | 376.5 | 508.79 |

FIGURE 22B (continued)

| | | | | | | | |
|---|---|---|---|---|---|---|---|
| 200 | 267.45 | 277.85 | 265.49 | 300.01 | 535.99 | 315.33 | 563.39 |
| 201 | 414.1 | 209.26 | 389.63 | 447.03 | 704.17 | 533.38 | 606.64 |
| 202 | 702.54 | 622.66 | 506.76 | 887.7 | 1280.35 | 902.88 | 1236.37 |
| 203 | 562.75 | 314.93 | 512.53 | 482.74 | 699.39 | 791.42 | 899.59 |
| 204 | 176.32 | 180.1 | 192.77 | 232.45 | 379.17 | 247.14 | 362.22 |
| 205 | 629.29 | 458.8 | 613.35 | 651.07 | 1183.61 | 987.06 | 799.55 |
| 206 | 342.38 | 206.66 | 284.15 | 335.68 | 601.51 | 395.73 | 459.67 |
| 207 | 271.67 | 202.61 | 343.8 | 307.21 | 558.1 | 415.73 | 421.02 |
| 208 | 430 | 247.26 | 315.46 | 443.18 | 686.4 | 481.82 | 615.21 |
| 209 | 1559.47 | 729.14 | 1615.57 | 1698.99 | 2185.57 | 2100.15 | 2626.25 |
| 210 | 662.81 | 397.68 | 634.11 | 643.3 | 1107.81 | 940.38 | 839.18 |
| 211 | 222.23 | 162.57 | 220.06 | 269.77 | 416.59 | 274.84 | 388.42 |
| 212 | 198.65 | 151.97 | 226.1 | 213.29 | 320.21 | 308.37 | 336.35 |
| 213 | 1380.47 | 792.07 | 1290.47 | 1682.72 | 2232.77 | 1953.77 | 2136.47 |
| 214 | 372.07 | 247.11 | 335.34 | 290.23 | 459.08 | 423.98 | 642.32 |
| 215 | 566.12 | 321.59 | 390.04 | 561 | 789.62 | 590.84 | 888.3 |
| 216 | 200.62 | 121.34 | 232.22 | 226.78 | 326.33 | 286.45 | 343.48 |
| 217 | 246.19 | 144.99 | 211.15 | 234.88 | 314.82 | 301.03 | 411.93 |
| 218 | 1721.33 | 840.27 | 1669.65 | 1755.13 | 2306.27 | 2166.06 | 2773.47 |
| 219 | 704.75 | 519.05 | 747.7 | 748.74 | 1333.75 | 871.82 | 1091.69 |
| 220 | 259 | 166.63 | 282.19 | 337.55 | 408.79 | 375.26 | 479.62 |
| 221 | 762.24 | 437.4 | 762.93 | 712.17 | 1160.49 | 930.78 | 1073.37 |
| 222 | 421.07 | 252.08 | 477.89 | 578.49 | 728.91 | 622.27 | 701.27 |
| 223 | 436.26 | 347.21 | 430.15 | 487.11 | 692.96 | 626.57 | 710.07 |
| 224 | 255.08 | 191.63 | 252.08 | 299.78 | 352.3 | 389.18 | 420.82 |
| 225 | 643.97 | 457.99 | 643.94 | 704.09 | 1101.19 | 747.64 | 992.5 |
| 226 | 274.58 | 299.77 | 293.16 | 323.11 | 563.29 | 405.68 | 409.07 |
| 227 | 186.13 | 172.79 | 219.76 | 232.07 | 339.35 | 262.31 | 339.85 |
| 228 | 457.34 | 362.32 | 508.79 | 494.57 | 785.83 | 563.9 | 719.97 |
| 229 | 297.86 | 227.4 | 320.96 | 414 | 512.8 | 427.09 | 503.93 |
| 230 | 1134.57 | 717.69 | 898.31 | 1436.2 | 1584.96 | 1523.99 | 1635.62 |
| 231 | 853.21 | 716.93 | 927.26 | 1001.4 | 1324.43 | 1206.98 | 1396.24 |
| 232 | 298.82 | 186.1 | 288.38 | 265.88 | 378.11 | 395.22 | 375.85 |

FIGURE 22C

| SEQ ID | common name | description |
|---|---|---|
| 1 | Sphingosine kinase 2 | UI-M-BH1-ame-a-08-0-UI.s1 NIH_BMAP_M_S2 Mus musculus cDNA clone UI-M-BH1-ame-a-08-0-UI 3', mRNA sequence. |
| 2 | Krt1-16 | intermediate filament protein |
| 3 | 1300007C21Rik | truncated; Mouse endogenous retrovirus truncated gag protein, complete cds, clone del env-1 3.1. |
| 4 | RIKEN cDNA 1110038L14 | vr45a06.s1 Knowles Solter mouse 2 cell Mus musculus cDNA clone IMAGE:1123570 5' similar to gb:X54942 CDK |
| 5 | Sprr1a | MSPRR1A; similar to mSPRR1A encoded by GenBank Accession Number M19888; Mus musculus SPRR 1A (Sprr1a) gene |
| 6 | RIKEN cDNA 1300019I03 | UI-M-AQ1-adx-c-06-0-UI.s1 NIH_BMAP_MHI_N Mus musculus cDNA clone UI-M-AQ1-adx-c-06-0-UI 3', mRNA sequence. |
| 7 | Mail-pending | vo32e09.r1 Barstead mouse irradiated colon MPLRB7 Mus musculus cDNA clone IMAGE:1051624 5', mRNA sequence. |
| 8 | MAIL | AV374591 RIKEN full-length enriched, adult male cecum Mus musculus cDNA clone 9130013H11 3', mRNA sequence. |
| 9 | Mylh | Mus musculus non-muscle myosin light chain 3 (MLC3nm) mRNA, partial cds. |
| 10 | Stimulated by retinoic acid 14 | M.musculus mRNA for basic-helix-loop-helix protein. |
| 11 | ab, SCD, Scd-1 | stearoyl-CoA desaturase; Mouse stearoyl-CoA desaturase gene, exon 6. |
| 12 | Interferon-related regulator 1 | reading frame interferon beta-2; Messenger RNA fragment for mouse interferon beta (type 2) coding for the C-terminal part. |
| 13 | | Mus musculus mRNA for BTEB-1 transcription factor. |
| 14 | Ser (or cys) proteinase inhib | Mouse RNA for plasminogen activator inhibitor 2. |
| 15 | Expressed sequence AW558171 | UI-M-BH2.3-aoa-g-07-0-UI.s1 NIH_BMAP_M_S3.3 Mus musculus cDNA clone UI-M-BH2.3-aoa-g-07-0-UI 3', mRNA seq |
| 16 | | C78850 Mouse 3.5-dpc blastocyst cDNA Mus musculus cDNA clone J0056C12 3' similar to mouse proviral retroviral insertion |
| 17 | ADAMTS-1 | putative; Mouse mRNA for secretory protein containing thrombospondin motifs, complete cds. |
| 18 | C/EBP, beta | Mouse alpha-1-acid glycoprotein (AGP/EBP) mRNA, complete cds. |
| 19 | | C85523 Mouse fertilized one-cell-embryo cDNA Mus musculus cDNA clone J0209F01 3', mRNA sequence. |
| 20 | DNA segment, Chr 8 ERATO Doi 814, expressed | UI-M-BH2.2-aoo-b-05-0-UI.s1 NIH_BMAP_M_S3.2 Mus musculus cDNA clone UI-M-BH2.2-aoo-b-05-0-UI 3', mRNA seq |
| 21 | Nfkbi | Mus musculus I kappa B alpha gene, exons 2-6, partial cds. |
| 22 | Transketolase | Mus musculus LAF1 transketolase mRNA, complete cds. |
| 23 | RIKEN cDNA 1300002F13 gene | uo89c05.x1 NCI_CGAP_Mam3 Mus musculus cDNA clone IMAGE:2649704 3', mRNA sequence. |
| 24 | MT-I, Mt-1 | Mouse gene for Metallothionein-I (three exons). |
| 25 | Cytokine ind SH2-cont protein 3 | AV374868 RIKEN full-length enriched, adult male cecum Mus musculus cDNA clone 9130017A09 3' similar to U88328 |
| 26 | ab, SCD, Scd-1 | stearoyl-CoA desaturase; Mouse stearoyl-CoA desaturase gene, exon 6. |
| 27 | Ctsc | Cathepsin C |
| 28 | C/EBP, delta | M.musculus mRNA for C/EBP delta. |
| 29 | Jun-B oncogene | Mus musculus transcription factor junB (junB) gene, 5' region and complete cds. |
| 30 | Atf3 | leucine zipper protein; Mus musculus transcription factor LRG-21 mRNA, complete cds. |
| 31 | Immediate early response, erythropoietin 1 | UI-M-BH1-amp-g-08-0-UI.s1 NIH_BMAP_M_S2 Mus musculus cDNA clone UI-M-BH1-amp-g-08-0-UI 3', mRNA sequence. |
| 32 | ADFP | Mouse adipose differentiation related protein (ADFP) mRNA, complete cds. |
| 33 | mCPE-R | Mus musculus mCPE-R mRNA for CPE-receptor, complete cds. |
| 34 | Jun-B oncogene | Mus musculus transcription factor junB (junB) gene, 5' region and complete cds. |
| 35 | Nfil3 | Mus musculus NFIL3/E4BP4 transcription factor mRNA, complete cds. |
| 36 | Sat | putative; Mouse spermidine/spermine N1-acetyltransferase (SSAT) mRNA, complete cds. |
| 37 | Cish3 | Mus musculus suppressor of cytokine signalling-3 (SOCS-3) mRNA, complete cds. |
| 38 | Antigen identified by mAb Ki 67 | M.musculus mRNA for Ki-67. |
| 39 | Expressed sequence C77826 | UI-M-BH2.2-aox-b-05-0-UI.s1 NIH_BMAP_M_S3.2 Mus musculus cDNA clone UI-M-BH2.2-aox-b-05-0-UI 3', mRNA seq |
| 40 | Nuclear factor of kappa light chain gene enhancer in B-cells inhibitor, alpha | ub75b05.x1 Soares_mammary_gland_NMLMG Mus musculus cDNA clone IMAGE:1383537 3' similar to gb:M69043. |

FIGURE 22C (continued)

| | | |
|---|---|---|
| 41 | HB-EGF | Mus musculus (clone lambda mouse 1) heparin-binding EGF-like growth factor precursor mRNA, complete cds. |
| 42 | pgk1 | X-linked; Mus musculus X chromosome-linked phosphoglycerate kinase (pgk-1) mRNA, complete cds. |
| 43 | RIKEN cDNA 5033417E09 gene | ud61f11.x1 Sugano mouse liver mlia Mus musculus cDNA clone IMAGE:1450413 3' similar to gb:L32179 |
| 44 | Pyruvate dehydrogenase kinase 4 | Mus musculus mRNA for pyruvate dehydrogenase kinase-like protein. |
| 45 | Leukemia-associated gene | UI-M-AL0-abv-e-12-0-UI.s1 NIH_BMAP_MCO Mus musculus cDNA clone UI-M-AL0-abv-e-12-0-UI 3', mRNA sequence. |
| 46 | Claudin 1 | integral membrane protein localizing at tight junctions; Mus musculus claudin-1 mRNA, complete cds. |
| 47 | Potassium inwardly-rectifying channel, subfamily J, member 12 | M.musculus MB-IRK2 mRNA. |
| 48 | RIKEN cDNA 1110032C13 gene | UI-M-AP1-agn-a-04-0-UI.s1 NIH_BMAP_MST_N Mus musculus cDNA clone UI-M-AP1-agn-a-04-0-UI 3', mRNA sequence. |
| 49 | Thyroid hormone receptor alpha | Mus musculus orphan nuclear receptor Rev-Erb-beta mRNA, partial cds. |
| 50 | Proteasome (prosome, macropain) subunit, beta type 8 (large multifunctional protease 7) | Lmp7k, s, f allele; Mus musculus 20S proteasome subunit Lmp7 (Lmp7k, s, f allele) mRNA, complete cds. |
| 51 | aldh3 | Mus musculus aldehyde dehydrogenase 3 (aldh3) gene, partial cds. |
| 52 | Butyrate response factor 2 | vw64d05.s1 Soares_mammary_gland_NMLMG Mus musculus cDNA clone IMAGE:1248585 3', mRNA sequence. |
| 53 | TSA-1 | Mus musculus thymic shared antigen-1 (TSA-1) gene, complete cds. |
| 54 | c-myc | Mouse c-myc gene exon 3. |
| 55 | MMSTK1 | putative serine/threonine kinase; Mouse mRNA for STK-1 (serine/threonine kinase), complete cds. |
| 56 | EIF 1A | translation initiation factor; Mus musculus eIF-1A (eIF-1A) mRNA, complete cds. |
| 57 | GRO1 oncogene | secretory protein KC precursor; Mouse platelet-derived growth factor-inducible KC protein mRNA, complete cds. |
| 58 | IGF binding protein 2 | M.musculus mRNA for insulin-like growth factor binding protein-2. |
| 59 | Expressed sequence AI314958 | uj34f07.x1 Sugano mouse kidney mkia Mus musculus cDNA clone IMAGE:1921861 3', mRNA sequence. |
| 60 | Mkrn3 | Mus musculus 14-3-3 protein sigma mRNA, complete cds. |
| 61 | | UI-M-BH1-ald-c-09-0-UI.s1 NIH_BMAP_M_S2 Mus musculus cDNA clone UI-M-BH1-ald-c-09-0-UI 3', mRNA sequence. |
| 62 | Kruppel-like factor 9 | UI-M-AH1-agp-g-10-0-UI.s1 NIH_BMAP_MCE_N Mus musculus cDNA clone UI-M-AH1-agp-g-10-0-UI 3', mRNA sequence. |
| 63 | FGF binding protein 1 | heparin and fibroblast growth factor binding; similar to Homo sapiens HBp17 protein encoded by seq in AN M60047; FGFBP-1 |
| 64 | Period homolog (Drosophila) | circadian pacemaker protein; Mus musculus Rigui mRNA, complete cds. |
| 65 | TGFB induc. early growth resp. | zinc finger protein; Mus musculus transcription factor GIF mRNA, complete cds. |
| 66 | RIKEN cDNA 4930455J02 gene | ul21f04.y1 Sugano mouse embryo mewa Mus musculus cDNA clone IMAGE:2088223 5' sim to SW:Y33K_HUMAN Q04323 |
| 67 | RIKEN cDNA 1300002F13 gene | UI-M-BH0-ajd-f-01-0-UI.s1 NIH_BMAP_M_S1 Mus musculus cDNA clone UI-M-BH0-ajd-f-01-0-UI 3', mRNA sequence. |
| 68 | Zinc finger protein 36 | TIS11 (AA 1 - 183); Mouse TPA-induced TIS11 mRNA. |
| 69 | RIKEN cDNA 1190002H23 gene | UI-M-BG1-aic-e-02-0-UI.s1 NIH_BMAP_MSC_N Mus musculus cDNA clone UI-M-BG1-aic-e-02-0-UI 3', mRNA sequence. |
| 70 | High mobility group box 2 | M.musculus mRNA for high mobility group 2 protein. |
| 71 | Metallothionein 2 | metallothionien II; Mouse metallothionein II (MT-II) gene. |
| 72 | Myd116 | MyD116 protein (AA 1-657); Mouse myeloid differentiation primary response mRNA encoding MyD116 protein. |
| 73 | CDK inhibitor 1A (P21) | UI-M-BH1-amo-d-08-0-UI.s1 NIH_BMAP_M_S2 Mus musculus cDNA clone UI-M-BH1-amo-d-08-0-UI 3', mRNA sequence. |
| 74 | Stromal cell derived factor 1 | AV139913 Mus musculus C57BL/6J 10-11 day embryo Mus musculus cDNA clone 2810055D15, mRNA sequence. |
| 75 | Cyr61 | Cyr61 product; Mouse Cyr61 mRNA, complete cds. |
| 76 | RIKEN cDNA 1600029D21 gene | uc30b06.r1 Soares_mammary_gland_NbMMG Mus musculus cDNA clone IMAGE:1399475 5', mRNA sequence. |
| 77 | Purine-nucleoside phosphorylase | Mus musculus purine nucleoside phosphorylase (Np-b) mRNA, complete cds. |
| 78 | BAR, B2AR, ADRBR, ADRB2R | Mouse gene for beta-2-adrenergic receptor. |
| 79 | RIKEN cDNA 2310076D10 gene | UI-M-AH1-agw-h-03-0-UI.s1 NIH_BMAP_MCE_N Mus musculus cDNA clone UI-M-AH1-agw-h-03-0-UI 3', mRNA sequence. |
| 80 | Paired-like homeodomain TF 2 | bicoid-related homeodomain protein; murine homolog of Rieger syndrome; mouse bicoid-rel homeodomain prot solurshin (Rgs) |
| 81 | Keratin complex 1, acidic, gene 17 | epidermal keratin type I; Mouse type I epidermal keratin mRNA, clone pkSCC-50, 3' end. |

FIGURE 22C (continued)

| | | |
|---|---|---|
| 82 | Growth arrest and DNA-damage-inducible 45 beta | AV138783 Mus musculus C57BL/6J 10-11 day embryo Mus musculus cDNA clone 2810046L02, mRNA sequence. |
| 83 | Rrm1 | ribonucleotide reductase subunit M1; Mouse ribonucleotide reductase subunit M1 mRNA, complete cds. |
| 84 | Ncl | Mouse nucleolin gene. |
| 85 | PCNA | Murine PCNA gene for proliferating cell nuclear antigen (DNA polymerase delta auxiliary protein). |
| 86 | H-2T17 | MHC H2-TL-T17-c; Mouse MHC class I H2-TL-T17-c mRNA (d haplotype), complete cds. |
| 87 | Expressed sequence AI467657 | vf37g06.y1 Soares mouse NbMH Mus musculus cDNA clone IMAGE:846010 5' similar to SW:PLZF_HUMAN Q05516 |
| 88 | Nr4a1 | Mouse N10 gene for a nuclear hormonal binding receptor. |
| 89 | Lectin, galactose binding, sol 7 | Mus musculus galectin-7 mRNA, complete cds. |
| 90 | HKII | Mus musculus gene for hexokinase II, exon 1 (and joined CDS). |
| 91 | Sequestosome 1 | similar to D. melanogaster Ref(2)Pp protein; Mus musculus oxidative stress-induced protein mRNA, complete cds. |
| 92 | Mcm5, Cdc46, mCD46 | put. mouse homolog of yeast CDC46; Mouse mRNA for mCDC46 protein, complete cds. |
| 93 | DNA segment, Chr 13, WSU 123, e | ul20f06.y1 Sugano mouse embryo mewa Mus musculus cDNA clone IMAGE:2088131 5' similar to SW:YBC4_YEAST P38205 |
| 94 | | Mouse histone H2A.1 gene, complete cds. |
| 95 | RIKEN cDNA 3100004P22 gene | UI-M-BG0-aht-a-11-0-UI.s1 NIH_BMAP_MSC Mus musculus cDNA clone UI-M-BG0-aht-a-11-0-UI 3', mRNA sequence. |
| 96 | Expressed sequence AU018108 | vo73e09.r1 Barstead mouse myotubes MPLRB5 Mus musculus cDNA clone IMAGE:1064776 5', mRNA sequence. |
| 97 | Kruppel-like factor 13 | UI-M-BH2.2-aql-f-08-0-UI.s1 NIH_BMAP_M_S3.2 Mus musculus cDNA clone UI-M-BH2.2-aql-f-08-0-UI 3', mRNA sequence. |
| 98 | E26 avian leuk oncogen 2, 3' dom | ets2 protein; Mouse erythroblastosis virus oncogene homolog 2 (ets-2) mRNA, complete cds. |
| 99 | H2-Q8 | Mouse Q8/9d gene. |
| 100 | TACSTD 2 | vz06h06.x1 Soares_mammary_gland_NbMMG Mus musculus cDNA clone IMAGE:1314971 3' similar to gb:J04152_rna1 |
| 101 | Fosl1 | Fra-1; B-Zip transcription factor; subunit of AP-1 member of the Fos family; Mus musculus fos-related antigen 1 (fra-1) gene |
| 102 | Immediate early response 3 | M.musculus gly96 mRNA. |
| 103 | TGFB inducible early growth resp | zinc finger protein; Mus musculus transcription factor GIF mRNA, complete cds. |
| 104 | RIKEN cDNA 5730403B10 gene | UI-M-AK1-aes-b-10-0-UI.s1 NIH_BMAP_MHY_N Mus musculus cDNA clone UI-M-AK1-aes-b-10-0-UI 3', mRNA sequence. |
| 105 | Pre B-cell leukemia TF 1 | UI-M-BH2.1-apu-g-09-0-UI.s1 NIH_BMAP_M_S3.1 Mus musculus cDNA clone UI-M-BH2.1-apu-g-09-0-UI 3', mRNA seq |
| 106 | MHC Q2-k | Mouse MHC (Qa) Q2-k gene for class I antigen, exons 1-3. |
| 107 | | MHC beta-2-microglobulin; Mouse MHC class I Q4 beta-2-microglobulin (Qb-1) gene, complete cds. |
| 108 | RIKEN cDNA 2810484M10 gene | UI-M-BH2.1-aph-h-08-0-UI.s1 NIH_BMAP_M_S3.1 Mus musculus cDNA clone UI-M-BH2.1-aph-h-08-0-UI 3', mRNA seq |
| 109 | Irs2 | IRS-2; Mus musculus insulin receptor substrate-2 (Irs2) gene, partial cds. |
| 110 | Thra | UI-M-AM1-afw-b-05-0-UI.s1 NIH_BMAP_MAM_N Mus musculus cDNA clone UI-M-AM1-afw-b-05-0-UI 3', mRNA seq |
| 111 | DNA segment, Chr 19, ERATO Doi 410, expressed | UI-M-BH0-akh-e-08-0-UI.s1 NIH_BMAP_M_S1 Mus musculus cDNA clone UI-M-BH0-akh-e-08-0-UI 3', mRNA sequence. |
| 112 | RIKEN cDNA 2700038D15 gene | UI-M-BH1-ame-a-04-0-UI.s1 NIH_BMAP_M_S2 Mus musculus cDNA clone UI-M-BH1-ame-a-04-0-UI 3', mRNA sequence. |
| 113 | Eph receptor B4 | Mus musculus Balb/c eph-related receptor protein tyrosine kinase mRNA, complete cds. |
| 114 | Secreted modular calcium-binding | pua31a05.r1 Soares_mammary_gland_NbMMG Mus musculus cDNA clone IMAGE:1348304 5', mRNA sequence. |
| 115 | RIKEN cDNA 2610008O03 gene | UI-M-AK1-aet-h-03-0-UI.s1 NIH_BMAP_MHY_N Mus musculus cDNA clone UI-M-AK1-aet-h-03-0-UI 3', mRNA sequence. |
| 116 | Cystatin B | also known as stefin B; Mus musculus cystatin B (Stfb) gene, complete cds. |
| 117 | Expressed sequence AA408168 | ud93d03.r1 Soares_NMPu Mus musculus cDNA clone IMAGE:1478405 5', mRNA sequence. |
| 118 | RIKEN cDNA 5730469M10 gene | UI-M-BG0-aia-g-01-0-UI.s1 NIH_BMAP_MSC Mus musculus cDNA clone UI-M-BG0-aia-g-01-0-UI 3', mRNA sequence. |
| 119 | Hydroxysteroid (17-beta) dehyd 12 | Mus musculus putative steroid dehydrogenase (KIK-I) mRNA, complete cds. |
| 120 | Expressed sequence AU044290 | UI-M-AK1-aes-e-01-0-UI.s1 NIH_BMAP_MHY_N Mus musculus cDNA clone UI-M-AK1-aes-e-01-0-UI 3', mRNA sequence. |
| 121 | WSB-1 | Mus musculus WSB-1 mRNA, complete cds. |

FIGURE 22C (continued)

| | | |
|---|---|---|
| 122 | Supp of initiator codon mutations, related sequence 1 (S. cerevisiae) | homolog of human sui1iso1, yeast sui1 and rice gos2; M.musculus mRNA for Sui1. |
| 123 | B-cell receptor-associated prot 37 | M.musculus mRNA for B-cell receptor associated protein (BAP) 37. |
| 124 | NM 2 protein (NM23B) (nucleoside diphosphate kinase) | M.musculus mRNA for nucleoside diphoshate kinase B. |
| 125 | Solute carrier family 25 (mitochondrial carrier; ANT), member 5 | mj83h01.r1 Soares mouse p3NMF19.5 Mus musculus cDNA clone IMAGE:482737 5' similar to gb:J02683 ADP,ATP CARRIER PROTEIN, FIBROBLAST ISOFORM (HUMAN); gb:X70847 M.musculus mRNA for adenine nucleotide translocase |
| 126 | | vw19g10.y1 Soares_mammary_gland_NbMMG Mus musculus cDNA clone IMAGE:1244322 5' sim to SW:ZAN_PIG Q28983 |
| 127 | Pik3r1 | PI3K regulatory subunit; Mus musculus phosphoinositide 3-kinase regulatory subunit p85alpha mRNA, complete cds. |
| 128 | RIKEN cDNA 6330577E15 gene | UI-M-BH1-ami-f-05-0-UI.s2 NIH_BMAP_M_S2 Mus musculus cDNA clone UI-M-BH1-ami-f-05-0-UI 3', mRNA sequence. |
| 129 | TGF beta 1 induced transcript 4 | M.musculus TSC-22 mRNA. |
| 130 | ABS, sub-family B (MDR/TAP), member 2 | Mus musculus antigen processing-associated transporter TAP1-g7 mRNA, complete cds. |
| 131 | Ran | Mouse (clone M2) GTPase (Ran) mRNA, complete cds. |
| 132 | Peroxisomal delta3, delta2-ECI | UI-M-AH0-acu-e-04-0-UI.s1 NIH_BMAP_MCE Mus musculus cDNA clone UI-M-AH0-acu-e-04-0-UI 3', mRNA sequence. |
| 133 | rbm3 | Mus musculus rbm3 mRNA, complete cds. |
| 134 | DNA segment, Chr 10, ERATO Doi 214, expressed | UI-M-AH1-ags-f-11-0-UI.s1 NIH_BMAP_MCE_N Mus musculus cDNA clone UI-M-AH1-ags-f-11-0-UI 3', mRNA sequence. |
| 135 | Keratin complex 1, acidic, gen 19 | AU040563 Mouse four-cell-embryo cDNA Mus musculus cDNA clone J0812H07 3', mRNA sequence. |
| 136 | TG interacting factor | M.musculus mRNA for mTGIF protein. |
| 137 | RIKEN cDNA 1110004C05 gene | UI-M-BH2.3-aqh-c-06-0-UI.s1 NIH_BMAP_M_S3.3 Mus musculus cDNA clone UI-M-BH2.3-aqh-c-06-0-UI 3', mRNA seq |
| 138 | | histone H2B-291A (AA 1 - 126); histone H2A-291A (AA 1 - 135); Mouse H2B and H2A histone genes (291A). |
| 139 | SGK | UI-M-BH1-akw-d-06-0-UI.s1 NIH_BMAP_M_S2 Mus musculus cDNA clone UI-M-BH1-akw-d-06-0-UI 3', mRNA sequence. |
| 140 | EMAP 2 | Mus musculus endothelial-monocyte activating polypeptide II mRNA, complete cds. |
| 141 | Actin related protein 2/3 complex, subunit 1B (41 kDa) | uo66e09.x1 NCI_CGAP_Mam1 Mus musculus cDNA clone IMAGE:2647528 3', mRNA sequence. |
| 142 | Expressed sequence AA536646 | UI-M-AK1-aez-g-04-0-UI.s1 NIH_BMAP_MHY_N Mus musculus cDNA clone UI-M-AK1-aez-g-04-0-UI 3', mRNA sequence. |
| 143 | Solute carrier family 2 (GLUT), mem | facilitated glucose transporter; Mouse facilitated glucose transport protein mRNA, complete cds. |
| 144 | Ornithine aminotransferase | M.musculus Oat mRNA for ornithine aminotransferase. |
| 145 | GST omega 1 | UI-M-AK1-aes-f-05-0-UI.s1 NIH_BMAP_MHY_N Mus musculus cDNA clone UI-M-AK1-aes-f-05-0-UI 3', mRNA sequence. |
| 146 | | UI-M-AK0-adl-e-02-0-UI.s1 NIH_BMAP_MHY Mus musculus cDNA clone UI-M-AK0-adl-e-02-0-UI 3', mRNA sequence. |
| 147 | B-cell leukemia/lymphoma 6 | homolog of human oncogene, BCL-6; Mus musculus BCL-6 mRNA, complete cds. |
| 148 | H2A histone family, member Z | histone H2A.Z; Mus musculus histone H2A.Z (H2A.Z) mRNA, complete cds. |
| 149 | mot2, Hsc74, Hsp74, Hsp74a, mortalin | Mouse gene for mitochondrial stress-70 protein (PBP74/CSA), exon 14,15,16 and 17. |
| 150 | Fosb | fosB protein (AA 1-338); Mouse fosB mRNA. |
| 151 | B-cell leukemia/lymphoma 10 | Mus musculus mRNA for bcl-10 protein. |
| 152 | HMG nucleosomal binding dom 2 | HMG-17 protein (AA 1 - 90); Mouse mRNA for HMG-17 chromosomal protein. |
| 153 | RIKEN cDNA 1500040F11 gene | UI-M-BH1-anw-c-09-0-UI.s1 NIH_BMAP_M_S2 Mus musculus cDNA clone UI-M-BH1-anw-c-09-0-UI 3', mRNA sequence. |
| 154 | EIF 3, subunit 8 (110 kDa) | similar to yeast NIP1 nuclear import protein; transmembrane protein; contains several potential phosphorylation sites for PKC and casein kinase II; Mus musculus NIPI-like protein (NIPIL(A3)) mRNA, complete cds. |
| 155 | Claudin 1 | vv68a06.x1 Stratagene mouse skin (#937313) Mus musculus cDNA clone IMAGE:1227538 3', mRNA sequence. |
| 156 | RIKEN cDNA 2900010I05 gene | UI-M-BG0-ahs-b-12-0-UI.s1 NIH_BMAP_MSC Mus musculus cDNA clone UI-M-BG0-ahs-b-12-0-UI 3', mRNA sequence. |

FIGURE 22C (continued)

| | | |
|---|---|---|
| 157 | RIKEN cDNA 2310008N12 gene | UI-M-BH1-alk-c-09-0-UI.s1 NIH_BMAP_M_S2 Mus musculus cDNA clone UI-M-BH1-alk-c-09-0-UI 3', mRNA sequence. |
| 158 | Fatty acid Coenzyme A ligase, long chain 5 | UI-M-AP0-abl-g-11-0-UI.s1 NIH_BMAP_MST Mus musculus cDNA clone UI-M-AP0-abl-g-11-0-UI 3', mRNA sequence. |
| 159 | RIKEN cDNA 1810015C04 gene | UI-M-BH2.1-apa-d-07-0-UI.s1 NIH_BMAP_M_S3.1 Mus musculus cDNA clone UI-M-BH2.1-apa-d-07-0-UI 3', mRNA seq |
| 160 | Ier2 | Mouse growth factor-inducible protein (pip92) mRNA, complete cds. |
| 161 | Keratin complex 1, acidic, gene 17 | epidermal keratin type I; Mouse type I epidermal keratin mRNA, clone pkSCC-50, 3' end. |
| 162 | DNA segment, Chr 6, ERATO Doi 109, expressed | UI-M-AO1-aeg-h-09-0-UI.s1 NIH_BMAP_MPG_N Mus musculus cDNA clone UI-M-AO1-aeg-h-09-0-UI 3', mRNA sequence. |
| 163 | Cytochr c oxidase, subunit Vb | cytochrome c oxidase subunit Vb precursor; Mouse mRNA for mitochondrial cytochrome c oxidase subunit Vb. |
| 164 | Atf3 | leucine zipper protein; Mus musculus transcription factor LRG-21 mRNA, complete cds. |
| 165 | Zinc finger protein 216 | Mus musculus zinc finger protein ZNF216 mRNA, complete cds. |
| 166 | Solute carrier family 25 (mito-chondrial carrier; ANT), member 5 | Mus musculus adenine nucleotide translocase mRNA, complete cds. |
| 167 | Epha2 | similar to human eck gene product, Swiss-Prot Accession Number P29317; Mus musculus receptor-protein tyrosine kinase (eck) |
| 168 | Tubb5 | beta-tubulin [AA 1-444] (79 is 1st base in codon); Mouse mRNA for beta-tubulin (isotype Mbeta 5). |
| 169 | Carboxypeptidase E | Mouse mRNA for carboxypeptidase H. |
| 170 | Solute carrier family 3 (activators of dibasic and neutral AA transport), member 2 | 4F2 heavy chain (AA 1-526); Murine mRNA for 4F2 antigen heavy chain. |
| 171 | FGF inducible 14 | Mus musculus fibroblast growth factor inducible gene 14 (FIN14) mRNA, complete cds. |
| 172 | Kcnj6 | Mus musculus G-protein coupled inwardly rectifying K+ channel (Girk2C) mRNA, complete cds. |
| 173 | Peroxiredoxin 5, related seq 3 | CP-2; Mus musculus 1-Cys peroxiredoxin protein 2 gene, complete cds. |
| 174 | Ldlr | Low density lipoprotein receptor |
| 175 | Scin | gelsolin-like protein; Mus musculus ADSEVERIN mRNA, complete cds. |
| 176 | H-2T10 | MHC H2-TL-T10-129; Mouse MHC class I H2-TL-T10-129 mRNA (b haplotype), complete cds. |
| 177 | Expressed sequence C85189 | UI-M-BH2.3-aoj-d-12-0-UI.s1 NIH_BMAP_M_S3.3 Mus musculus cDNA clone UI-M-BH2.3-aoj-d-12-0-UI 3', mRNA sequence. |
| 178 | LPS-induced TNF-alpha factor | UI-M-BH0-aiu-f-10-0-UI.s1 NIH_BMAP_M_S1 Mus musculus cDNA clone UI-M-BH0-aiu-f-10-0-UI 3', mRNA sequence. |
| 179 | NRF2 | CNC basic leucine zipper DNA binding protein; Mus musculus p45 NF-E2 related factor 2 (NRF2) gene |
| 180 | HS 10 kDa protein 1 (chaperonin 10 | heat shock protein 10, HSP10; Mus musculus chaperonin 10 mRNA, complete cds. |
| 181 | Midnolin | UI-M-BH2.1-aqa-h-06-0-UI.s1 NIH_BMAP_M_S3.1 Mus musculus cDNA clone UI-M-BH2.1-aqa-h-06-0-UI 3', mRNA sequence. |
| 182 | Cops6 | similar to human Vpr interacting protein (hVIP) ; 34 kDa human MOV34 isologue; subunit 6 is a 36 kDa component of the COP9 complex which contains a total of 8 distinct subunits, similar to the JAB1-containing signalosome; mouse COPS6 mRNA |
| 183 | | |
| 184 | Silica-induced gene 81 | partial homology to cytochrome C oxidase subunit VII; M.musculus mRNA for cytochrome C oxidase subunit VII homologue. |
| 185 | PTP, receptor type, J | Mus musculus mRNA, one isoform of PTP-RL9. |
| 186 | Btg1 | M.musculus btg1 mRNA. |
| 187 | EIF factor 5a | UI-M-AH0-acw-e-01-0-UI.s1 NIH_BMAP_MCE Mus musculus cDNA clone UI-M-AH0-acw-e-01-0-UI 3', mRNA sequence. |
| 188 | RIKEN cDNA 2010306B17 gene | UI-M-AQ1-aec-e-01-0-UI.s1 NIH_BMAP_MHI_N Mus musculus cDNA clone UI-M-AQ1-aec-e-01-0-UI 3', mRNA sequence. |
| 189 | RIKEN cDNA 2610103L06 gene | UI-M-BH2.1-apy-g-01-0-UI.s1 NIH_BMAP_M_S3.1 Mus musculus cDNA clone UI-M-BH2.1-apy-g-01-0-UI 3', mRNA sequence. |
| 190 | RIKEN cDNA 0610010M09 gene | UI-M-BH2.1-apm-e-09-0-UI.s1 NIH_BMAP_M_S3.1 Mus musculus cDNA clone UI-M-BH2.1-apm-e-09-0-UI 3', mRNA sequence. |
| 191 | | UI-M-AI0-aaq-a-05-0-UI.s1 NIH_BMAP_MBS Mus musculus cDNA clone UI-M-AI0-aaq-a-05-0-UI 3', mRNA sequence. |
| 192 | Heat shock protein, 60 kDa | HSP60 protein (555 AA); Mouse mRNA for HSP60 protein (clones 3T3-7, -9, and -M1). |
| 193 | Gapd | glyceraldehyde-3-phosphate dehydrogenase; Mouse glyceraldehyde-3-phosphate dehydrogenase mRNA, complete cds. |
| 194 | Protein tyrosine phosphatase 4a2 | potentially prenylated protein tyrosine phosphatase; Mus musculus potentially prenylated protein tyrosine phosphatase mPRL-2 |

FIGURE 22C (continued)

| | | |
|---|---|---|
| 195 | gene 37 | Murine gene 37 for pot. membrane bound protein. |
| 196 | RIKEN cDNA 1110032G10 gene | UI-M-BH2.3-aqh-b-06-0-UI.s1 NIH_BMAP_M_S3.3 Mus musculus cDNA clone UI-M-BH2.3-aqh-b-06-0-UI 3', mRNA sequence. |
| 197 | Isocitrate dehydrogenase 3 (NAD+), gamma | Mus musculus NAD(H)-specific isocitrate dehydrogenase gamma subunit precursor, mRNA, complete cds. |
| 198 | RIKEN cDNA 1110021D01 gene | UI-M-BH2.1-apy-h-02-0-UI.s1 NIH_BMAP_M_S3.1 Mus musculus cDNA clone UI-M-BH2.1-apy-h-02-0-UI 3', mRNA sequence. |
| 199 | Carboxypeptidase E | Mouse mRNA for carboxypeptidase H. |
| 200 | Cpo | Mouse mRNA for coproporphyrinogen oxidase, complete cds. |
| 201 | Sid394 | Mus musculus mRNA for Sid394p, complete cds. |
| 202 | Protein tyrosine phosphatase 4a1 | Mus musculus protein tyrosine phosphatase (PRL-1) mRNA, complete cds. |
| 203 | mc/EPB | Mouse CCAAT/enhancer binding protein gene, complete cds. |
| 204 | Zinc finger protein 36 | MTA.G11.085.A MTA adult mouse thymus library Mus musculus cDNA clone MTA.G11.085 5' end similar to xenopus XCAP-C |
| 205 | mATF4 | murine homolog of TAXREB67/ATF4; M.musculus mATF4 (mTR67) mRNA, complete cds. |
| 206 | NADH dehydrogenase (ubiquinone) flavoprotein 2 | UI-M-AP1-agg-c-11-0-UI.s1 NIH_BMAP_MST_N Mus musculus cDNA clone UI-M-AP1-agg-c-11-0-UI 3', mRNA sequence. |
| 207 | Expressed sequence AI430822 | UI-M-BH0-ajl-f-03-0-UI.s1 NIH_BMAP_M_S1 Mus musculus cDNA clone UI-M-BH0-ajl-f-03-0-UI 3', mRNA sequence. |
| 208 | Inosine 5'-phosphate dehydrog 2 | IMP dehydrogenase (EC 1.2.1.14); Mouse IMP dehydrogenase mRNA, complete cds. |
| 209 | | MHC Q4 class I antigen (31 AA) (119 is 2nd base in codon); Protein sequence is in conflict with the conceptual translation; Mouse Q4 class I MHC gene (exon 5). |
| 210 | Aquaporin 2 | va26c10.x1 GuayWoodford Beier mouse kidney day 7 Mus musculus cDNA clone IMAGE:732498 3', mRNA sequence. |
| 211 | Expressed sequence AA987150 | UI-M-AO0-ach-a-08-0-UI.s1 NIH_BMAP_MPG Mus musculus cDNA clone UI-M-AO0-ach-a-08-0-UI 3', mRNA sequence. |
| 212 | Expressed sequence C76856 | UI-M-AJ1-agy-b-09-0-UI.s1 NIH_BMAP_MOB_N Mus musculus cDNA clone UI-M-AJ1-agy-b-09-0-UI 3', mRNA sequence. |
| 213 | Hist4 | Mouse histone H3 (H3.2-221) gene, complete cds. |
| 214 | Enolase 1, alpha non-neuron | UI-M-AM0-adv-h-04-0-UI.s1 NIH_BMAP_MAM Mus musculus cDNA clone UI-M-AM0-adv-h-04-0-UI 3', mRNA sequence. |
| 215 | Eif4 | unidentified reading frame; put. eIF-4A (aa 1-390); put. altern. eIF-4A (aa 1-370); Mouse mRNA for initiation factor eIF-4AI. |
| 216 | TGF beta regulated gene 1 | UI-M-BH1-anm-f-07-0-UI.s1 NIH_BMAP_M_S2 Mus musculus cDNA clone UI-M-BH1-anm-f-07-0-UI 3', mRNA sequence. |
| 217 | D6Ertd109e | Mus musculus mRNA for eRF1, partial cds. |
| 218 | Histocompatibility 2, L region | ub83g12.r1 Soares_thymus_2NbMT Mus musculus cDNA clone IMAGE:1395142 5' similar to gb:K01762_ma1 |
| 219 | Aldolase 1, A isoform | aldolase A; Mouse mRNA for aldolase A. |
| 220 | | vr30d10.r1 Barstead mouse myotubes MPLRB5 Mus musculus cDNA clone IMAGE:1122163 5', mRNA sequence. |
| 221 | Apoc1 | Source: M.musculus Apoc1 gene, exons 1 to 3 and complete CDS. |
| 222 | Tripartite motif protein 28 | M.musculus mRNA for TIF1 beta protein. |
| 223 | Ethanol induced 6 | UI-M-AK1-aeu-f-09-0-UI.s1 NIH_BMAP_MHY_N Mus musculus cDNA clone UI-M-AK1-aeu-f-09-0-UI 3', mRNA sequence. |
| 224 | CDC 2 homolog A (S. pombe) | Mouse cell cycle protein (p34 CDC2) mRNA, complete cds. |
| 225 | Basic transcription factor 3 | UI-M-BH2.1-apb-b-08-0-UI.s1 NIH_BMAP_M_S3.1 Mus musculus cDNA clone UI-M-BH2.1-apb-b-08-0-UI 3', mRNA sequence. |
| 226 | MAP kinase 6 | UI-M-AH1-agx-b-06-0-UI.s1 NIH_BMAP_MCE_N Mus musculus cDNA clone UI-M-AH1-agx-b-06-0-UI 3', mRNA sequence. |
| 227 | Expressed sequence C81323 | vz48h05.r1 Soares_thymus_2NbMT Mus musculus cDNA clone IMAGE:1329753 5' similar to SW:SSRP_MOUSE Q08943 |
| 228 | Clk | Mouse serine threonine tyrosine kinase (STY) mRNA, complete cds. |
| 229 | Arha2 | RHOA; Mus musculus Rho family GTPase (ArhA) mRNA, complete cds. |
| 230 | Histone gene complex 1 | M.domesticus (CD-1) mRNA for histone H3 (partial). |
| 231 | Dp1 | Mus musculus GP106 mRNA, complete cds. |
| 232 | RIKEN cDNA 1300019P08 gene | AV218217 RIKEN full-length enriched, adult male hippocampus Mus musculus cDNA clone 2900087J21 3' similar to L12016 |

METHODS FOR GENERATING NEW HAIR FOLLICLES, TREATING BALDNESS, AND HAIR REMOVAL

CROSS-REFERENCE TO RELATED APPLICATIONS

This application is a continuation of U.S. patent application Ser. No. 11/887,104, filed Sep. 25, 2007 now abandoned, which is a National Phase Application of PCT International Application PCT/US06/11319, filed Mar. 28, 2006, claiming priority to U.S. Provisional Patent Applications 60/665,857 and 60/683,293, filed 29 Mar. 2005, and 23 May, 2005, respectively, all of which are incorporated by reference herein in their entirety.

FIELD OF INVENTION

The present invention provides methods of treating baldness in a subject and generating new hair follicles, comprising epidermal disruption and administration of a compound that promotes a differentiation of an uncommitted epidermal cell into a hair follicle cell. The present invention also provides methods for hair removal and inducing hair pigmentation.

BACKGROUND OF THE INVENTION

Follicular neogenesis is defined as the generation of new hair follicles (HF) after birth. Humans are born with a full complement of HF, which can change in size and growth characteristics as in early baldness or can ultimately degenerate and disappear as in late stages of baldness or in permanent scarring (cicatricial) alopecias. Therefore, the generation of new HF is desirable in the treatment of common baldness as well as less common hair loss conditions, such as discoid lupus erythematosus, congenital hypotrichosis, lichen planopilaris and other scarring alopecias.

SUMMARY OF THE INVENTION

The present invention provides methods of treating baldness in a subject and generating new hair follicles (HF), comprising epidermal disruption and administration of a compound that promotes a differentiation of an uncommitted epidermal cell into a hair follicle cell. The present invention also provides methods for hair removal and inducing hair pigmentation.

In one embodiment, the present invention provides a method for generating a hair follicle in a scalp, eyebrow, or scarred region of a subject, comprising the steps of (a) disrupting the epidermis of the scalp, eyebrow, or scarred region; and (b) contacting the scalp, eyebrow, or scarred region with a compound that promotes a differentiation of an uncommitted epidermal cell into a hair follicle cell, thereby generating a hair follicle in a scalp, eyebrow, or scarred region of a subject.

In another embodiment, the present invention provides a method for generating a hair follicle in a scalp, eyebrow, or scarred region of a subject, comprising the steps of (a) disrupting the epidermis of the scalp, eyebrow, or scarred region; and (b) contacting the scalp, eyebrow, or scarred region with a factor that promotes a differentiation of an uncommitted epidermal cell into a hair follicle cell, thereby generating a hair follicle in a scalp, eyebrow, or scarred region of a subject.

In another embodiment, the present invention provides a method for treating baldness in a scalp, eyebrow, or scarred region, comprising the steps of: (a) disrupting the epidermis of the scalp, eyebrow, or scarred region; and (b) contacting the scalp, eyebrow, or scarred region with a compound that promotes a differentiation of an uncommitted epidermal cell into a hair follicle (HF) cell, thereby treating baldness in a scalp, eyebrow, or scarred region.

In another embodiment, the present invention provides a method for treating baldness in a scalp, eyebrow, or scarred region, comprising the steps of: (a) disrupting the epidermis of the scalp, eyebrow, or scarred region; and (b) contacting the scalp, eyebrow, or scarred region with a factor that promotes a differentiation of an uncommitted epidermal cell into a HF cell, thereby treating baldness in a scalp, eyebrow, or scarred region. In another embodiment, the baldness is an androgenetic alopecia (AGA)-induced baldness. Each possibility represents a separate embodiment of the present invention.

In another embodiment, the present invention provides a method for removal of an HF from a skin or scalp of a subject, comprising the steps of (a) disrupting an epidermis of the skin or scalp; and (b) contacting the skin or scalp with either: (i) an EGF protein; (ii) an EGF receptor; (iii) a nucleotide encoding an EGF protein or EGF receptor; or (iv) a compound or factor that activates a EGF protein or EGF receptor, thereby removing an HF from a skin or scalp of a subject.

In another embodiment, the present invention provides a method for increasing a size of a hair follicle in a scalp, eyebrow, or scarred region of a subject, the method comprising the steps of: (a) disrupting an epidermis of the scalp, eyebrow, or scarred region; and (b) contacting the scalp, eyebrow, or scarred region with a compound or factor that promotes a differentiation of an uncommitted epidermal cell into a hair follicle cell, thereby increasing a size of a hair follicle in a scalp, eyebrow, or scarred region of a subject.

In another embodiment, the present invention provides a method for generating a hair follicle in a scalp, eyebrow, or scarred region of a subject, comprising the steps of: (a) disrupting an epidermis of said scalp, eyebrow, or scarred region; and (b) contacting said scalp, eyebrow, or scarred region with a cell selected from (a) a precursor cell that is capable of differentiation into a hair follicle cell; (b) an inductive cell that is capable of inducing differentiation of an uncommitted epidermal cell into a hair follicle cell; or (c) a hair follicle or portion thereof, thereby generating a hair follicle in a scalp, eyebrow, or scarred region of a subject. In another embodiment, step (b) is performed 3-12 days after step (a). Each possibility represents a separate embodiment of the present invention.

In another embodiment, the present invention provides a method for treating an AGA in a scalp, comprising the steps of: (a) disrupting an epidermis of said scalp; and (b) contacting said scalp with a cell selected from (a) a precursor cell that is capable of differentiation into a hair follicle cell; (b) an inductive cell that is capable of inducing differentiation of an uncommitted epidermal cell into a hair follicle cell; or (c) a hair follicle or portion thereof, thereby treating an AGA in a scalp. In another embodiment, step (b) is performed 3-12 days after step (a). Each possibility represents a separate embodiment of the present invention.

BRIEF DESCRIPTION OF THE FIGURES

FIG. 22. Transcripts up-regulated at least 2-fold in activated HF cells, as assessed by dChip analysis. (A). Mean values and standard errors of the up-regulated transcripts in non-activated ("bs-line") and activated ("expt") samples and fold-changes and differences between non-activated and activated values are depicted. (B). Raw data for up-regulated transcripts in non-activated and activated cells. "Ctrl" denotes non-activated and "High-dep" denotes activated cells. (C). Additional information about up-regulated transcripts.

DETAILED DESCRIPTION OF THE INVENTION

Figure 1:
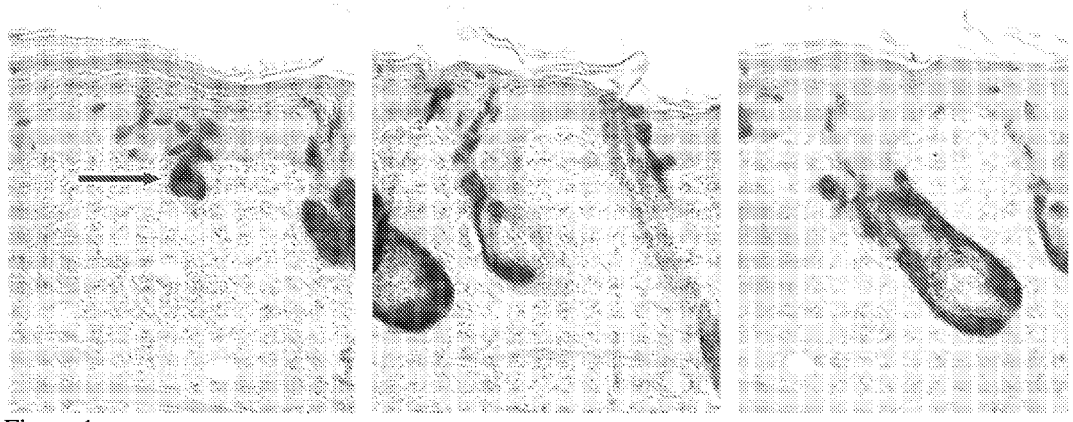
FIG. 1: Epidermal abrasion results in de novo hair follicle (HF) formation. HF at progressive stages of development are depicted in the left, center, and right panels. The arrow in the left panel indicates a hair germ. The dark stained cells are progeny of HF stem cells in the bulge.

The present invention provides methods of treating baldness in a subject and generating new HF, comprising epidermal disruption and administration of a compound that promotes a differentiation of an uncommitted epidermal cell into a hair follicle cell. The present invention also provides methods for hair removal and inducing hair pigmentation.

In one embodiment, the present invention provides a method for generating a hair follicle (HF) in a scalp, eyebrow, or scarred region of a subject, comprising the steps of: (a) disrupting an epidermis of the scalp, eyebrow, or scarred region; and (b) contacting the scalp, eyebrow, or scarred region with a compound that promotes a differentiation of an uncommitted epidermal cell into an HF cell, thereby generating an HF in a scalp, eyebrow, or scarred region of a subject.

In another embodiment, the present invention provides a method for generating an HF in a scalp, eyebrow, or scarred region of a subject, comprising the steps of (a) disrupting an epidermis of the scalp, eyebrow, or scarred region; and (b) contacting the scalp, eyebrow, or scarred region with a factor that promotes a differentiation of an uncommitted epidermal cell into an HF cell, thereby generating an HF in a scalp, eyebrow, or scarred region of a subject.

In another embodiment, the present invention provides a method for generating a new HF in a scalp, eyebrow, or scarred region of a subject, comprising the steps of: (a) disrupting an epidermis of the scalp, eyebrow, or scarred region; and (b) contacting the scalp, eyebrow, or scarred region with a compound or factor that promotes a differentiation of an uncommitted epidermal cell into a hair follicle cell, thereby generating a new HF in a scalp, eyebrow, or scarred region of a subject.

In another embodiment, the present invention provides a method for increasing the number of HF in a scalp, eyebrow, or scarred region of a subject, comprising the steps of: (a) disrupting an epidermis of the scalp, eyebrow, or scarred region; and (b) contacting the scalp, eyebrow, or scarred region with a compound or factor that promotes a differentiation of an uncommitted epidermal cell into an HF cell, thereby increasing the number of HF in a scalp, eyebrow, or scarred region of a subject.

In another embodiment, the present invention provides a use of a compound or factor that promotes a differentiation of an uncommitted epidermal cell into an HF cell, for the preparation of a pharmaceutical composition for use in a method for generating a hair follicle in a scalp, eyebrow, or scarred region of a subject, the method comprising the steps of: (a) disrupting an epidermis of the scalp, eyebrow, or scarred region; and (b) contacting the scalp, eyebrow, or scarred region with the compound or factor.

In another embodiment, the present invention provides a use of a compound or factor that promotes a differentiation of an uncommitted epidermal cell into an HF cell, for the preparation of a pharmaceutical composition for use in a method for treating baldness in a scalp, eyebrow, or scarred region of a subject, the method comprising the steps of: (a) disrupting an epidermis of the scalp, eyebrow, or scarred region; and (b) contacting the scalp, eyebrow, or scarred region with the compound or factor.

In another embodiment, the present invention provides a use of a compound or factor that promotes a differentiation of an uncommitted epidermal cell into an HF cell, for the preparation of a pharmaceutical composition for use in a method for treating AGA in a scalp of a subject, the method comprising the steps of (a) disrupting an epidermis of the scalp, eyebrow, or scarred region; and (b) contacting the scalp with the compound or factor.

In another embodiment, the present invention provides a method for increasing a size of a hair follicle in a scalp, eyebrow, or scarred region of a subject, the method comprising the steps of: (a) disrupting an epidermis of the scalp, eyebrow, or scarred region; and (b) contacting the scalp, eyebrow, or scarred region with a compound or factor that promotes a differentiation of an uncommitted epidermal cell into an HF cell, thereby increasing a size of a hair follicle in a scalp, eyebrow, or scarred region of a subject. In another embodiment, the factor is an inhibitor of an EGF protein or an EGFR. In another embodiment, the factor is a Hedgehog protein, a nucleotide encoding same or an activator of same. In another embodiment, the factor is an androgen antagonist. In another embodiment, the factor is any other compound or factor that promotes a differentiation of an uncommitted epidermal cell into an HF cell. Each possibility represents a separate embodiment of the present invention.

In another embodiment, the present invention provides a method for generating a hair follicle in a scalp, eyebrow, or scarred region of a subject, comprising the steps of: (a) disrupting an epidermis of said scalp, eyebrow, or scarred region; and (b) contacting said scalp, eyebrow, or scarred region with a cell selected from (a) a precursor cell that is capable of differentiation into a hair follicle cell; (b) an inductive cell that is capable of inducing differentiation of an uncommitted epidermal cell into a hair follicle cell; or (c) a hair follicle or portion thereof, thereby generating a hair follicle in a scalp, eyebrow, or scarred region of a subject. In another embodiment, step (b) is performed 3-12 days after step (a). Each possibility represents a separate embodiment of the present invention.

The precursor cell of methods and compositions of the present invention, is, in another embodiment, a HF stem cell. In another embodiment, the precursor cell is an epidermal cell. In another embodiment, the precursor cell is a dermal papilla cell. In another embodiment, the precursor cell is a connective tissue sheath cell. In another embodiment, the precursor cell is any other type of cell known in the art that is capable of differentiation into a hair follicle cell. Each possibility represents a separate embodiment of the present invention.

In another embodiment, the present invention provides a method for generating a hair follicle in a scalp, eyebrow, or scarred region of a subject, comprising the steps of: (a) disrupting an epidermis of said scalp, eyebrow, or scarred region; and (b) contacting said scalp, eyebrow, or scarred region with a precursor cell that is capable of differentiation into a hair follicle cell, thereby generating a hair follicle in a scalp, eyebrow, or scarred region of a subject.

In another embodiment, the present invention provides a method for treating an AGA in a scalp, comprising the steps of: (a) disrupting an epidermis of said scalp; and (b) contacting said scalp with a cell selected from (a) a precursor cell that is capable of differentiation into a hair follicle cell; (b) an inductive cell that is capable of inducing differentiation of an uncommitted epidermal cell into a hair follicle cell; or (c) a hair follicle or portion thereof, thereby treating an AGA in a scalp. In another embodiment, step (b) is performed 3-12 days after step (a). Each possibility represents a separate embodiment of the present invention.

In another embodiment, the present invention provides a method for treating an AGA in a scalp, comprising the steps of: (a) disrupting an epidermis of said scalp; and (b) contacting said scalp with a precursor cell that is capable of differentiation into a hair follicle cell, thereby treating an AGA in a scalp.

In another embodiment, the inductive cell is a mesenchymal cell. In another embodiment, the inductive cell is any other type of inductive cell enumerated herein. In another embodiment, the inductive cell is any other type of inductive cell known in the art. Each possibility represents a separate embodiment of the present invention.

"Contacting" as used herein refers, in another embodiment, to bringing the scalp, eyebrow, etc, into to contact with the compound, factor, cell, etc. In another embodiment, the term refers to embedding the compound, factor, cell, etc into the scalp, eyebrow, etc. In another embodiment, the term refers to injecting the compound, factor, cell, etc into the scalp, eyebrow, etc. In another embodiment, term refers to any other type of contacting known in the art. Each possibility represents a separate embodiment of the present invention.

"Promotes a differentiation" refers, in another embodiment, to the act of increasing the percentage of cells that will differentiate as indicated. In another embodiment, the term refers to increasing the number of cells per unit area of skin that will differentiate. In another embodiment, the promoter of differentiation is active in the milieu of the skin. Each possibility represents a separate embodiment of the present invention.

"Uncommitted epidermal cell" refers, in another embodiment, to an epidermal stem cell. In another embodiment, the epidermal cell is a bulge cell. In another embodiment, the epidermal cell is a bulge-derived cell. In another embodiment, the epidermal cell is any other type of cell known in the art that can be induced to differentiate into an HF cell.

The "HF cell" that results from the differentiation is, in another embodiment, an HF stem cell. In another embodiment, the HF cell is a dermal papilla cell. In another embodiment, the HF cell is a bulb cell. In another embodiment, the HF cell is a matrix cell. In another embodiment, the HF cell is a hair shaft cell. In another embodiment, the HF cell is an inner root sheath cell. In another embodiment, the HF cell is an outer root sheath cell. In another embodiment, the HF cell is a melanocyte stem cell. In another embodiment, the HF cell is a melanocyte. Each type of uncommitted epidermal cell and HF cell represents a separate embodiment of the present invention.

In another embodiment, the present invention provides a method for treating baldness in a scalp, eyebrow, or scarred region, comprising the steps of: (a) disrupting an epidermis of the scalp, eyebrow, or scarred region; and (b) contacting the scalp, eyebrow, or scarred region with a compound that promotes a differentiation of an uncommitted epidermal cell into a hair follicle (HF) cell, thereby treating baldness in a scalp, eyebrow, or scarred region. In another embodiment, the baldness is an androgenetic alopecia (AGA)-induced baldness. Each possibility represents a separate embodiment of the present invention.

In another embodiment, the present invention provides a method for treating baldness in a scalp, eyebrow, or scarred region, comprising the steps of (a) disrupting an epidermis of the scalp, eyebrow, or scarred region; and (b) contacting the scalp, eyebrow, or scarred region with a factor that promotes a differentiation of an uncommitted epidermal cell into a HF cell, thereby treating baldness in a scalp, eyebrow, or scarred region. In another embodiment, the baldness is an androgenetic alopecia (AGA)-induced baldness. Each possibility represents a separate embodiment of the present invention.

In another embodiment, the compound or factor that promotes a differentiation of an uncommitted epidermal cell into a HF cell is administed in a solution. In another embodiment, the compound or factor is administed in a cream. In another embodiment, the compound or factor is administed in an ointment. In another embodiment, the compound or factor is administed in a slow release formulation. In another embodiment, the compound or factor is administed in a liposome encapsulated formulation. In another embodiment, the compound or factor is directly injected. In another embodiment, the compound or factor is administed by any other method known in the art. Each possibility represents a separate embodiment of the present invention.

The compound or factor that promotes a differentiation of an uncommitted epidermal cell into a HF cell is, in another embodiment, an inhibitor of an Epidermal Growth Factor (EGF). In another embodiment, the compound or factor is an inhibitor of an EGF receptor. Each possibility represents a separate embodiment of the present invention.

As provided herein (Example 11), activating one or more pathways in which EGF is involved (by injection of EGF) blocks the formation of HF. Thus, antagonizing the pathway increases HF formation, as demonstrated in Example 12.

In another embodiment, the inhibitor of an EGF or an EGF receptor is panitumumab. In another embodiment, the inhibitor is AG1478. In another embodiment, the inhibitor is nimotuzumab. In another embodiment, the inhibitor is an antibody that binds EGF or EGFR. In another embodiment, the inhibitor is HuMax-EGFR® (Genmab, Copenhagen, Denmark). In another embodiment, the inhibitor is cetuximab. In another embodiment, the inhibitor is IMC 11F8. In another embodiment, the inhibitor is matuzumab. In another embodiment, the inhibitor is SC 100. In another embodiment, the inhibitor is ALT 110. In another embodiment, the inhibitor is PX 1032. In another embodiment, the inhibitor is BMS 599626. In another embodiment, the inhibitor is MDX 214. In another embodiment, the inhibitor is PX 1041. In another embodiment, the inhibitor is any other inhibitor of an EGF or an EGF receptor known in the art. Each possibility represents a separate embodiment of the present invention.

In another embodiment, the compound or factor that promotes a differentiation of an uncommitted epidermal cell into a HF cell is an inhibitor of a tyrosine kinase activity of an EGF receptor. In another embodiment, the inhibitor is gefitinib. In another embodiment, the inhibitor is erlotinib. In another embodiment, the inhibitor is canertinib. In another embodiment, the inhibitor is leflunomide. In another embodiment, the inhibitor is A77 1726. In another embodiment, the inhibitor is pelitinib. In another embodiment, the inhibitor is ZD 1839. In another embodiment, the inhibitor is CL 387785. In another embodiment, the inhibitor is EKI 785. In another embodiment, the inhibitor is vandetanib. In another embodiment, the inhibitor is any other inhibitor of a tyrosine kinase activity of an EGF receptor known in the art. Each possibility represents a separate embodiment of the present invention.

In another embodiment, the EGF or EGFR antagonist is a carboxypeptidase inhibitor from potato (PCI) protein or a homologue, fragment or mimetic thereof. In another embodiment, the EGF or EGFR antagonist is a sprouty protein or a homologue, fragment or mimetic thereof. In another embodiment, the EGF or EGFR antagonist is an Argos protein or a homologue, fragment or mimetic thereof. In another embodiment, the EGF or EGFR antagonist is a lefty protein or a homologue, fragment or mimetic thereof. In another embodiment, the EGF or EGFR antagonist is an antibody that recognizes EGF or EGFR, or a fragment or mimetic thereof. In another embodiment, the EGF or EGFR antagonist is small molecule inhibitor that binds and reduces the activity of EGF or EGFR. In another embodiment, the EGF or EGFR antagonist is CRM197. In another embodiment, the EGF or EGFR antagonist is IMC-C225 (ImClone Systems, New York, N.Y.). In another embodiment, the EGF or EGFR antagonist is any other antagonist of EGF or EGFR known in the art. Each possibility represents a separate embodiment of the present invention.

In another embodiment, the present invention provides a use of an inhibitor of an EGF protein or an EGF receptor for the preparation of a pharmaceutical composition for use in a method for generating a hair follicle in a scalp, eyebrow, or scarred region of a subject, the method comprising the steps of: (a) disrupting an epidermis of the scalp, eyebrow, or scarred region; and (b) contacting the scalp, eyebrow, or scarred region with the inhibitor of an EGF protein or an EGF receptor.

In another embodiment, the present invention provides a use of an inhibitor of an EGF protein or an EGF receptor for the preparation of a pharmaceutical composition for use in a method for treating baldness in a scalp, eyebrow, or scarred region of a subject, the method comprising the steps of: (a) disrupting an epidermis of the scalp, eyebrow, or scarred region; and (b) contacting the scalp, eyebrow, or scarred region with the inhibitor of an EGF protein or an EGF receptor.

In another embodiment, the present invention provides a use of an inhibitor of an EGF protein or an EGF receptor for the preparation of a pharmaceutical composition for use in a method for treating AGA in a scalp of a subject, the method comprising the steps of (a) disrupting an epidermis of the scalp, eyebrow, or scarred region; and (b) contacting the scalp with the inhibitor of an EGF protein or an EGF receptor.

In another embodiment, the compound or factor that promotes a differentiation of an uncommitted epidermal cell into a HF cell is a β-catenin protein. In another embodiment, the compound or factor is a nucleotide that encodes a β-catenin protein. In another embodiment, the compound or factor is an activator of a β-catenin protein. In another embodiment, the compound or factor is an inhibitor of a protein that suppresses an activity of the β-catenin protein. Each possibility represents a separate embodiment of the present invention.

In another embodiment, the present invention provides a use of (a) a β-catenin protein; (b) a nucleotide encoding a β-catenin protein; or (c) a compound or factor that activates a β-catenin protein, for the preparation of a pharmaceutical composition for use in a method for generating a hair follicle in a scalp, eyebrow, or scarred region of a subject, the method comprising the steps of: (a) disrupting an epidermis of the scalp, eyebrow, or scarred region; and (b) contacting the scalp, eyebrow, or scarred region with the β-catenin protein, nucleotide, compound or factor.

In another embodiment, the present invention provides a use of (a) a β-catenin protein; (b) a nucleotide encoding a β-catenin protein; or (c) a compound or factor that activates a β-catenin protein, for the preparation of a pharmaceutical composition for use in a method for treating baldness in a scalp, eyebrow, or scarred region of a subject, the method comprising the steps of: (a) disrupting an epidermis of the scalp, eyebrow, or scarred region; and (b) contacting the scalp, eyebrow, or scarred region with the β-catenin protein, nucleotide, compound or factor.

In another embodiment, the present invention provides a use of (a) a β-catenin protein; (b) a nucleotide encoding a β-catenin protein; or (c) a compound or factor that activates a β-catenin protein, for the preparation of a pharmaceutical composition for use in a method for treating AGA in a scalp of a subject, the method comprising the steps of: (a) disrupting an epidermis of the scalp, eyebrow, or scarred region; and (b) contacting the scalp with the β-catenin protein, nucleotide, compound or factor.

In another embodiment, the compound or factor that promotes a differentiation of an uncommitted epidermal cell into a HF cell is a fibroblast growth factor (FGF) protein. In another embodiment, the compound or factor is a nucleotide that encodes an FGF protein. In another embodiment, the compound or factor is an FGF receptor. In another embodiment, the compound or factor is a nucleotide that encodes an FGF receptor. In another embodiment, the compound or factor is an activator of an FGF protein. In another embodiment, the compound or factor is an activator of FGF receptor. In another embodiment, the compound or factor is an inhibitor of a protein that suppresses an activity of the FGF protein or FGF receptor. In another embodiment, the protein that is inhibited is an FGF binding protein. In another embodiment, the protein that is inhibited is FGF-bp1. Each possibility represents a separate embodiment of the present invention.

Is provided herein, FGF and its receptor are upregulated, under the conditions utilized herein, upon HF stem cell differentiation (Example 9). Moreover, FGF-bp1 is downregulated, under the conditions utilized herein, upon HF stem cell differentiation. Thus, FGF and its receptor promote differentiation of uncommitted epidermal cells into HF cells.

In another embodiment, the compound or factor that promotes a differentiation of an uncommitted epidermal cell into a HF cell is an ectodysplasin protein (referred to, in another embodiment, as "eda"; in another embodiment, as "ectodermodysplasin protein.") In another embodiment, the ectodysplasin protein is Eda-A1. In another embodiment, the compound or factor is an ectodysplasin receptor (referred to, in another embodiment, as "edar"). In another embodiment, the compound or factor is an activator of an ectodysplasin protein. In another embodiment, the compound or factor is an activator of an ectodysplasin receptor. In another embodiment, the compound or factor is an inhibitor of a protein that suppresses an activity of the ectodysplasin protein or ectodysplasin receptor. Each possibility represents a separate embodiment of the present invention.

In another embodiment, the eda protein of methods and compositions of the present invention has the sequence: MGYPEVERRELLPAAAPRERGSQGCGCGGAPAR-AGEGNSCLLFLGFFGLSLALHLLTLCC YLELRSELR-RERGAESRLGGSGTPGTSGTLSSLGGLDPDSPIT-SHLGQPSPKQQPLEPGEAAL HSDSQDGHQMALLN-FFFPDEKPYSEEESRRVRRNKRSKSNEGADGPV-KNKKKGKKAGPP GPNGPPGPPGPPGPQGPPGIPGIP-GIPGTTVMGPPGPPGPPGPQGPPGLQGPSGAAD-KAGTR ENQPAVVHLQGQGSAIQVKNDLSGGV-LNDWSRITMNPKVFKLHPRSGELEVLVDGTYFIY SQVEVYYINFTDFASYEVVVDEKPFLQCTRSIETG-KTNYNTCYTAGVCLLKARQKIAVKM VHADISINM-SKHTTFFGAIRLGEAPAS (GenBank Accession No: NM_001399; SEQ ID No: 274). In another embodiment, the eda protein has a sequence selected from the sequences set forth in GenBank entries NM_001005609, NM_001005610, NM_001005611, NM_001005612, NM_001005613, NM_001005614, NM_001005615, AF040628, AF061194, AF061193, AF061192, AF061191, AF061190, AF061189, and AF060999. In another embodiment, the eda protein is encoded by a nucleic acid molecule having a sequence set forth in the one of the above GenBank entries. In another embodiment, a biologically active fragment of an Eda protein is utilized in a method of the present invention. Each possibility represents a separate embodiment of the present invention.

In another embodiment, the edar protein of methods and compositions of the present invention has the sequence: MAHVGDCTQTPWLPVLVVSLMCSARAEY-SNCGENEYYNQTTGLCQECPPCGPGEEPYLS CGYGT-KDEDYGCVPCPAEKFSKGGYQICRRHKD-CEGFFRATVLTPGDMENDAECGPCLP GYYMLENRPRNIYGMVCYSCLLAPPNT-KECVGATSGASANFPGTSGSSTLSPFQHAHKELS GQGHLATALIIAMSTIFIMAIAIVLIIM-FYILKTKPSAPACCTSHPGKSVEAQVSKDEEKKEAP DNVVMFSEKDEFEKLTATPAKPTKSEN-DASSENEQLLSRSVDSDEEPAPDKQGSPELCLLS LVHLAREKSATSNKSAGIQSRRKKILD-VYANVCGVVEGLSPTELPFDCLEKTSRMLS STYN SEKAVVKTWRHLAESFGLKRDEIG-GMTDGMQLFDRIS TAGYSIPELLTKLVQIERLDAVES LCADILEWAGVVPPASQPHAAS (GenBank Accession No: BC093872; SEQ ID No: 275). In another embodiment, the edar protein has a sequence selected from the sequences set forth in GenBank entries BC093870; BC034919; NM_021783; NM_022336; AY152724; AF298812; AH008077; AF130996; AF130988. In another embodiment, the edar protein is encoded by a nucleic acid molecule having a sequence set forth in the one of the above GenBank entries. In another embodiment, a biologically active fragment of an Edar protein is utilized in a method of the present invention. Each possibility represents a separate embodiment of the present invention.

In another embodiment, the compound or factor that promotes a differentiation of an uncommitted epidermal cell into a HF cell is a Noggin protein. In another embodiment, the compound or factor is a nucleotide encoding a Noggin protein. In another embodiment, the compound or factor is an activator of a Noggin protein. In another embodiment, the compound or factor is an inhibitor of a protein that suppresses an activity of the Noggin protein. Each possibility represents a separate embodiment of the present invention.

In another embodiment, the Noggin protein of methods and compositions of the present invention has the sequence: MERCPSLGVTLYALVVVLGLRATPAG-GQHYLHIRPAPSDNLPLVDLIEHPDPIFDPKEKDLNE TLLRSLLGGHYDPGFMATSPPEDRPGGGG-GAAGGAEDLAELDQLLRQRPSGAMPSEIKGLE FSEGLAQGKKQRLSKKLRRKLQMWL-WSQTFCPVLYAWNDLGSRFWPRYVKVGSCFSKRS CSVPEGMVCKPSKSVHLTVLRWRCQRRG-GQRCGWIPIQYPIISECKCSC (GenBank Accession No: NM_005450; SEQ ID No: 276). In another embodiment, the Noggin protein has a sequence selected from the sequences set forth in GenBank entries BC034027 and U31202. In another embodiment, the Noggin protein is encoded by a nucleic acid molecule having a sequence set forth in the one of the above GenBank entries. In another embodiment, a biologically active fragment of a Noggin protein is utilized in a method of the present invention. Each possibility represents a separate embodiment of the present invention.

In another embodiment, the compound or factor that promotes a differentiation of an uncommitted epidermal cell into a HF cell is a Hedgehog protein. In another embodiment, the compound or factor is a nucleotide encoding a Hedgehog protein. In another embodiment, the compound or factor is an activator of a Hedgehog protein. In another embodiment, the compound or factor is a sonic Hedgehog protein. In another embodiment, the compound or factor is a nucleotide encoding a sonic Hedgehog protein. In another embodiment, the compound or factor is an activator of a sonic Hedgehog protein. Each possibility represents a separate embodiment of the present invention.

In another embodiment, the Hedgehog protein of methods and compositions of the present invention has the sequence set forth in GenBank Accession No. NM_000193. In another embodiment, the Hedgehog protein has a sequence selected from those set forth in GenBank entries L38518 and NP_000184. In another embodiment, the Hedgehog protein has any other Hedgehog sequence known in the art. In another embodiment, the Hedgehog protein has any other sonic Hedgehog sequence known in the art. Each possibility represents a separate embodiment of the present invention.

In another embodiment, the compound or factor that promotes a differentiation of an uncommitted epidermal cell into a HF cell is a Transforming Growth Factor (TGF)-beta1 protein. In another embodiment, the compound or factor is a nucleotide encoding a TGF-beta1 protein. In another embodiment, the compound or factor is an activator of a TGF-beta1 protein. In another embodiment, the compound or factor is a TGF-beta3 protein. In another embodiment, the compound or factor is a nucleotide encoding a TGF-beta3 protein. In another embodiment, the compound or factor is an activator of a TGF-beta3 protein. In another embodiment, the compound or factor is an antagonist of a TGF-beta1 protein. In another embodiment, the compound or factor is an antagonist of a TGF-beta3 protein. Each possibility represents a separate embodiment of the present invention.

In another embodiment, the TGF-beta1 protein of methods and compositions of the present invention has the sequence set forth in GenBank Accession No. BC000125. In another embodiment, the Hedgehog protein has a sequence selected from those set forth in GenBank entries BC001180, BC022242, and NM_000660. In another embodiment, the TGF-beta1 protein has any other TGF-beta1 sequence known in the art. Each possibility represents a separate embodiment of the present invention.

In another embodiment, the TGF-beta3 protein of methods and compositions of the present invention has the sequence set forth in GenBank Accession No. J03241. In another embodiment, the Hedgehog protein has a sequence selected from those set forth in GenBank entries NM_003239, BC018503, BT007287 and X14149. In another embodiment, the TGF-beta3 protein has any other TGF-beta3 sequence known in the art. Each possibility represents a separate embodiment of the present invention.

In another embodiment, the compound or factor that promotes a differentiation of an uncommitted epidermal cell into a HF cell acts directly on the uncommitted epidermal cell. In another embodiment, the compound or factor acts on the uncommitted epidermal cell via a mesenchymal cell. Each possibility represents a separate embodiment of the present invention.

In another embodiment, the mesenchymal cell is a dermal condensate cell. In another embodiment, the mesenchymal cell is a DP cell. In another embodiment, the mesenchymal cell is another cell type or differentiation stage in the dermal condensate-DP lineage. In another embodiment, the mesenchymal cell is any other type of mesenchymal cell known in the art. Each possibility represents a separate embodiment of the present invention.

The EGFR of methods and compositions of the present invention has, in another embodiment, the sequence: MRPSGTAGAALLALLAALCPASRALEEKKVCQGTS-NKLTQLGTFEDHFLSLQRMFNNCEV VLGNLE-ITYVQRNYDLSFLKTIQEVAGYVLIALNTVERIPL-ENLQIIRGNMYYENSYALAVL SNYDANKTGLKELP-MRNLQEILHGAVRFSNNPALCNVESIQWRDIVSS-DFLSNMSMDFQN HLGSCQKCDPSCPNGSCWGAG-EENCQKLTKIICAQQCSGRCRGKSPSDCCHNQCAA-GCTG PRESDCLVCRKFRDEATCKDTCPPLM-LYNPTTYQMDVNPEGKYSFGATCVKKCPRNYVV TDHGSCVRACGADSYEMEEDGVRKCKKCEGPC-RKVCNGIGIGEFKDSLSINATNIKHFKN CTSISGDL-HILPVAFRGDSFTHTPPLDPQELDILKTVKEITG-FLLIQAWPENRTDLHAFENLEII RGRTKQHGQFSLAV-VSLNITSLGLRSLKEISDGDVIISGNKNLCYANTINW-KKLFGTSGQKT KIISNRGENSCKATGQVCHALCSPE-GCWGPEPRDCVSCRNVSRGRECVDKCNLLEGEPREF VENSECIQCHPECLPQAMNITCTGRGPDNCIQCA-HYIDGPHCVKTCPAGVMGENNTLVWK YADAGH-VCHLCHPNCTYGCTGPGLEGCPTNGPKIPSIATGM-VGALLLLLVVALGIGLFMR RRHIVRKRTLRRLLQER-ELVEPLTPSGEAPNQALLRILKETEFKKIKVLGSGA-FGTVYKGLW IPEGEKVKIPVAIKELREATSPKAN-KEILDEAYVMASVDNPHVCRLLGICLT-STVQLITQLMP FGCLLDYVREHKDNIGSQYLLN-WCVQIAKGMNYLEDRRLVHRDLAARNVLVKTP-QHVKI TDFGLAKLLGAEEKEYHAEGGKVPIKW-MALESILHRIYTHQSDVWSYGVTVWELMTFGS KPYDGIPASEISSILEKGERLPQPPIC- TIDVYMIMVKCWMIDADSRPKFRELIIEFSKMARDPQ RYLVIQGDERMHLPSPTDSNFYRALM-DEEDMDDVVDADEYLIPQQGFFSSPSTSRTPLLSS LSATSNNSTVACIDRNGLQSCPIKEDS-FLQRYSSDPTGALTEDSIDDTFLPVPEYINQSVPKR PAGSVQNPVYHNQPLNPAPSRDPHYQD-PHSTAVGNPEYLNTVQPTCVNSTFDSPAHWAQ KGSH-QISLDNPDYQQDFFPKEAKPNGIFKGS-TAENAEYLRVAPQSSEFIGA (GenBank Accession No: NM_005228; SEQ ID No: 277). In another embodiment, the EGFR has a sequence selected from the sequences set forth in GenBank entries NM_201282, NM_201283, NM_201284, BC094761, AF288738, AY588246, AY573061, X17054, AF125253, U48722, K03193, and AY698024. In another embodiment, the EGFR is encoded by a nucleic acid molecule having a sequence set forth in the one of the above GenBank entries. In another embodiment, a biologically active fragment of an EGFR is utilized in a method of the present invention. Each possibility represents a separate embodiment of the present invention.

The EGF of methods and compositions of the present invention has, in another embodiment, the sequence: MLLTLIILLPVVSKFSFVSLSAPQHWSCPEGTL-AGNGNSTCVGPAPFLIFSHGNSIFRIDTEGTN YEQLV-VDAGVSVIMDFHYNEKRIYWVDLERQLLQRVFL-NGSRQERVCNIEKNVSGMAINW INEEVIWSNQQEGI-ITVTDMKGNNSHILLSALKYPANVAVDPVERFIFWS SEVAGSLYRADL DGVGVKALLETSEKITAVSLDVLD-KRLFWIQYNREGSNSLICSCDYDGGSVHISKIIPT-QHNL FAMSLFGDRIFYSTWKMKTIWIANKHT-GKDMVRINLHSSFVPLGELKVVHPLAQPKAEDDT WEPEQKLCKLRKGNCSSTVCGQDLQ SHLCMCA-EGYALSRDRKYCEDVNECAFWNHGCTL GCKNTPG-SYYCTCPVGFVLLPDGKRCHQLVSCPRN-VSECSHDCVLTSEGPLCFCPEGSVLER DGKTCSGCSSPDNGGCSQLCVPLSPVSW-ECDCFPGYDLQLDEKSCAASGPQPFLLFANSQDI RHMHFDGTDYGTLLSQQMGMVYALDHD-PVENKIYFAHTALKWIERANMDGSQRERLIEE GVD-VPEGLAVDWIGRRFYWTDRGKSLIGRS-DLNGKRSKIITKENISQPRGIAVHPMAKRLFW TDTGINPRIESSSLQGLGRLVIASSDLI-WPSGITIDFLTDKLYWCDAKQSVIEMANLDGSKRRR LTQNDVGHPFAVAVFEDYVWFSDWAMPS-VIRVNKRTGKDRVRLQGSMLKPSSLVVVHPL AKP-GADPCLYQNGGCEHICKKRLGTAWC-SCREGFMKASDGKTCLALDGHQLLAGGEVDL KNQVTPLDILSKTRVSEDNITESQHML-VAEIMVSDQDDCAPVGCSMYARCISEGEDATCQC LKGFAGDGKLCSDIDECEMGVPVCP-PASSKCINTEGGYVCRCSEGYQGDGIHCLDIDECQLG VHSCGENASCTNTEGGYTCMCAGRLSEPGLICPD-STPPPHLREDDHHYSVRNSDSECPLSHD GYCLHD-GVCMYIEALDKYACNCVVGYIGERCQYRDLKW-WELRHAGHGQQQKVIVVAVC VVVLVMLLLLSLW-GAHYYRTQKLLSKNPKNPYEESSRDVRSRRPADTE-DGMSSCPQPWFV VIKEHQDLKNGGQPVAGEDGQA-ADGSMQPTS WRQEPQLCGMGTEQGCWIPVSSDKG-SCP QVMERSFHMPSYGTQTLEGGVEKPHSLL-SANPLWQQRALDPPHQMELTQ (GenBank Accession No: NM_001963; SEQ ID No: 278). In another embodiment, the EGF has a sequence selected from the sequences set forth in GenBank entries BC093731, AY548762, and X04571. In another embodiment, the EGF is encoded by a nucleic acid molecule having a sequence set forth in the one of the above GenBank entries. In another embodiment, a biologically active fragment of an EGF is utilized in a method of the present invention. Each possibility represents a separate embodiment of the present invention.

The beta-catenin protein of methods and compositions of the present invention has, in another embodiment, the sequence: MATQADLMELDMAMEPDRKAAVSHWQQQ-SYLDSGIHSGATTTAPSLSGKGNPEEEDVDT SQVLY-EWEQGFSQSFTQEQVADIDGQYAMTRAQRVR-AAMFPETLDEGMQIPSTQFDAAHP TNVQRLAEPSQ-MLKHAVVNLINYQDDAELATRAIPELT-KLLNDEDQVVVNKAAVMVHQLS KKEASRHAIMR-SPQMVSAIVRTMQNTNDVETARCTAGTLHNL-SHHREGLLAWKSGGIPAL VKMLGSPVDSVLFYAIT-TLHNLLLHQEGAKMAVRLAGGLQKMVALLNKTN-VKFLAITTDC LQILAYGNQESKLIILASGGPQALVN-IMRTYTYEKLLWTTSRVLKVLSVCSSNKPAIVEAGG MQALGLHLTDPSQRLVQNCLWTLRNLSDAATKQEG-MEGLLGTLVQLLGSDDINVVTCAAG ILSNLTCN-NYKNKMMVCQVGGIEALVRTVLRAGDREDITEPA-ICALRHLTSRHQEAEMAQN AVRLHYGLPVVVKLLH-PPSHWPLIKATVGLIRNLALCPANHAPLREQGAI-PRLVQLLVRAHQ DTQRRTSMGGTQQQFVEG-VRMEEIVEGCTGALHILARDVHNRIVIRGLNTIPLF-VQLLYSPIE NIQRVAAGVLCELAQDKEAAEAIEAE-GATAPLTELLHSRNEGVATYAAAVLFRMSEDKPQD YKKRLSVELTSSLFRTEPMAWNETADLGLDIGAQ-GEPLGYRQDDPSYRSFHSGGYGQDALG MDPMME-HEMGGHHPGADYPVDGLPDLGHAQDLMDGLPP-GDSNQLAWFDTDL (GenBank Accession No: NM_001904; SEQ ID No: 279). In another embodiment, the beta-catenin protein has a sequence selected from the sequences set forth in GenBank entries BC058926, X87838, AF130085, AB062292, Z19054, and NP_001895. In another embodiment, the beta-catenin protein is encoded by a nucleic acid molecule having a sequence set forth in the one of the above GenBank entries. In another embodiment, a biologically active fragment of a beta-catenin protein is utilized in a method of the present invention. Each possibility represents a separate embodiment of the present invention.

The Wnt protein of methods and compositions of the present invention has, in another embodiment, the sequence: MNRKARRCLGHLFLSLGMVYLRIGGFSS-VVALGASIICNKIPGLAPRQRAICQSRPDAIIVIGE GSQMGLDECQFQFRNGRNCSALGERTVF-GKELKVGSREAAFTYAIIAAGVAHAITAACT QGNLS-DCGCDKEKQGQYHRDEGWKWGGCSA-DIRYGIGFAKVFVDAREIKQNARTLMNLH NNEAGRKILEENMKLECKCHGVSGSCTT-KTCWTTLPQFRELGYVLKDKYNEAVHVEPVRA SRNKRPTFLKIKKPLSYRKPMDT-DLVYIEKSPNYCEEDPVTGSVGTQGRAC-NKTAPQASGC DLMCCGRGYNTHQYARVWQCNCKF-HWCCYVKCNTCSERTEMYTCK (GenBank Accession No: BC008811; SEQ ID No: 280). In another embodiment, the Wnt protein has a sequence selected from the sequences set forth in GenBank entries NM_004625, D83175, U53476, and NP_004616. In another embodiment, the Wnt protein is a Wnt7 protein. In another embodiment, the Wnt protein is a Wnt7a protein. In another embodiment, the Wnt protein is Wnt1 protein. In another embodiment, the Wnt protein is a Wnt3 protein. In another embodiment, the Wnt protein is a Wnt3a protein. In another embodiment, the Wnt protein is a Wnt10 protein. In another embodiment, the Wnt protein is a Wnt10a protein. In another embodiment, the Wnt protein is a Wnt10b protein. In another embodiment, the Wnt protein is encoded by a nucleic acid molecule having a sequence set forth in the one of the above GenBank entries. In another embodiment, a biologically active fragment of a Wnt protein is utilized in a method of the present invention. In another embodiment, a biologically active fragment of a Wnt7 protein is utilized in a method of the present invention. In another embodiment, a biologically active fragment of a Wnt7a protein is utilized in a method of the present invention. Each possibility represents a separate embodiment of the present invention.

In another embodiment, the compound or factor that promotes a differentiation of an uncommitted epidermal cell into a HF cell is a protein encoded by a ribonucleic acid (RNA) molecule having a sequence selected from the sequences set forth in SEQ ID No: 1-232. In another embodiment, the compound or factor is an RNA molecule having a sequence selected from SEQ ID No: 1-232. In another embodiment, the RNA molecule is homologous to a sequence selected from SEQ ID No: 1-232. In another embodiment, the RNA molecule is an isoform of a sequence selected from SEQ ID No: 1-232. In another embodiment, the compound or factor increases an activity of a protein encoded by an RNA molecule having a sequence selected from SEQ ID No: 1-232. In another embodiment, the compound or factor increases an expression or level of a protein encoded by an RNA molecule having a sequence selected from SEQ ID No: 1-232. Each possibility represents a separate embodiment of the present invention.

As provided herein, the transcripts depicted in Table 3 (Example 8; SEQ ID No: 1-232), the proteins they encode, and the pathways in which the proteins participate contribute significantly to HF stem cell activation. Accordingly, under the conditions utilized herein, anagen can be induced by activation of these transcripts, proteins, and pathways. Activation of the transcripts, proteins, and pathways depicted in Table 3 is thus a method for enhancing EDIHN. In another embodiment, activation of these transcripts, proteins, and pathways represents a method for enhancing hair growth in a subject.

In another embodiment, the compound or factor that promotes a differentiation of an uncommitted epidermal cell into a HF cell is a protein encoded by an RNA molecule having a sequence selected from the sequences set forth in SEQ ID No: 233-257. In another embodiment, the compound or factor is an RNA molecule having a sequence selected from SEQ ID No: 233-257. In another embodiment, the RNA molecule is homologous to a sequence selected from SEQ ID No: 233-257. In another embodiment, the RNA molecule is an isoform of a sequence selected from SEQ ID No: 233-257. In another embodiment, the compound or factor increases an activity of a protein encoded by an RNA molecule having a sequence selected from SEQ ID No: 233-257. In another embodiment, the compound or factor increases an expression or level of a protein encoded by an RNA molecule having a sequence selected from SEQ ID No: 233-257. Each possibility represents a separate embodiment of the present invention.

As provided herein, the transcripts depicted in Table 4 (Example 9; SEQ ID No: 233-257), the proteins they encode, and the pathways in which the proteins participate, contribute significantly, under the conditions utilized herein, to induction of epidermal cells to differentiate into HF stem cells. Activation of the transcripts, proteins, and pathways depicted in Table 4 is thus a method for enhancing EDIHN. In another embodiment, activation of these transcripts, proteins, and pathways represents a method for enhancing hair growth in a subject.

In another embodiment, the compound or factor that promotes a differentiation of an uncommitted epidermal cell into a HF cell is a compound or factor that decreases an activity of a protein encoded by an RNA molecule having a sequence selected from the sequences set forth in SEQ ID No: 258-273. In another embodiment, the compound or factor decreases an expression or level of a protein encoded by an RNA molecule having a sequence selected from SEQ ID No: 258-273. Each possibility represents a separate embodiment of the present invention.

As demonstrated by findings of the present invention, the transcripts depicted in Table 5 (Example 9; SEQ ID No: 258-273), the proteins they encode, and the pathways in which the proteins participate, contribute significantly, under the conditions utilized herein, to preventing induction of epidermal cells to differentiate into HF stem cells. Inhibition of the transcripts, proteins, and pathways depicted in Table 5 is thus a method for enhancing EDIHN. In another embodiment, inhibition of these transcripts, proteins, and pathways represents a method for induction of hair growth in a subject.

In one embodiment, the compound that modulates a protein encoded by an RNA molecule having a sequence selected from the sequences set forth in SEQ ID No: 233-273 or the nucleic acid encoding same is administered before the compound that modulates a protein encoded by an RNA molecule having a sequence selected from the sequences set forth in SEQ ID No: 1-232 or the nucleic acid encoding same. In another embodiment, the two compounds are administered simultaneously. Each possibility represents a separate embodiment of the present invention.

In one embodiment, a protein encoded by an RNA sequence selected from SEQ ID No: 1-273, or a compound that modulates the protein, is administered before other proteins encoded by same or compounds that modulate them, in order to further enhance their effect in generating an HF or stimulating hair growth. In another embodiment, the wnt pathway is stimulated before the hedgehog pathway. In another embodiment, the two pathways are stimulated in an overlapping fashion. In another embodiment, the two pathways are stimulated simultaneously. Each possibility represents a separate embodiment of the present invention.

In another embodiment, activating or decreasing expression of an RNA transcript in methods of the present invention occurs via a transcription mechanism (e.g. activation of expression of the RNA). In another embodiment, activating or decreasing expression of the RNA transcript occurs via a translational mechanism. In another embodiment, activating or decreasing expression of the RNA transcript occurs via a post-translational mechanism. Each possibility represents a separate embodiment of the present invention.

In another embodiment, the nucleic acid molecule utilized in methods of the present invention is a deoxyribonucleic acid (DNA) molecule that encodes an RNA molecule having a sequence selected from the sequences set forth in the present invention.

In one embodiment, an RNA molecule of the present invention encodes a protein that plays a role in HF regeneration. In another embodiment, the RNA molecule is itself catalytically active, e.g., a ribozyme, etc. Each possibility represents a separate embodiment of the present invention.

In another embodiment, the compound or factor that promotes a differentiation of an uncommitted epidermal cell into a HF cell is a compound or factor that promotes placodal cell fate. As provided herein, factors that promote placodal cell fate enhance EDIHN, as exemplified in the Examples herein. In another embodiment, the compound or factor acts at the placode stage of HF development.

In another embodiment, the compound or factor inhibits a biological factor that inhibits a differentiation of an uncommitted epithelial cell into an HF cell.

In another embodiment of methods and compositions of the present invention, a composition comprising one of the above compounds or factors is administered. Each of the above types of compounds, factors, and compositions represents a separate embodiment of the present invention.

In one embodiment, the present invention provides a method for generating an HF in a scalp, eyebrow, or scarred region of a subject, comprising the steps of: (a) disrupting an epidermis of the scalp, eyebrow, or scarred region; and (b) contacting the scalp, eyebrow, or scarred region with minoxidil, thereby generating an HF in a scalp, eyebrow, or scarred region of a subject.

In one embodiment, the present invention provides a method for treating baldness in a scalp, eyebrow, or scarred region of a subject, comprising the steps of: (a) disrupting an epidermis of the scalp, eyebrow, or scarred region; and (b) contacting the scalp, eyebrow, or scarred region with minoxidil, thereby treating baldness in a scalp, eyebrow, or scarred region of a subject.

In another embodiment, the present invention provides a use of minoxidil for the preparation of a pharmaceutical composition for use in a method for an HF in a scalp, eyebrow, or scarred region of a subject, the method comprising the steps of: (a) disrupting an epidermis of the scalp, eyebrow, or scarred region; and (b) contacting the scalp, eyebrow, or scarred region with the minoxidil.

In another embodiment, the present invention provides a use of minoxidil for the preparation of a pharmaceutical composition for use in a method for treating baldness in a scalp, eyebrow, or scarred region of a subject, the method comprising the steps of: (a) disrupting an epidermis of the scalp, eyebrow, or scarred region; and (b) contacting the scalp, eyebrow, or scarred region with the minoxidil.

In another embodiment, the present invention provides a method for removal of an HF from a skin or scalp of a subject, comprising the steps of: (a) disrupting an epidermis of the skin or scalp; and (b) contacting the skin or scalp with either: (i) an EGF protein; (ii) an EGF receptor; (iii) a nucleotide encoding an EGF protein or EGF receptor; or (iv) a compound or factor that activates a EGF protein or EGF receptor, thereby removing an HF from a skin or scalp of a subject.

In another embodiment, the present invention provides a method for hair removal from a skin or scalp of a subject, comprising the steps of: (a) disrupting an epidermis of the skin or scalp; and (b) contacting the skin or scalp with either: (i) an EGF protein; (ii) an EGF receptor; (iii) a nucleotide encoding an EGF protein or EGF receptor; or (iv) a compound or factor that activates a EGF protein or EGF receptor, thereby removing hair from a skin or scalp of a subject. In another embodiment, the epidermal disruption is light dermabrasion. In another embodiment, the epidermal disruption is a non-scarring method. In another embodiment, administration of the EGF protein, EGF receptor, nucleotide, compound, or factor suppresses HF formation. In another embodiment, the EGF protein, EGF receptor, nucleotide, compound, or factor is administered within several days of healing. In another embodiment, the EGF protein, EGF receptor, nucleotide, compound, or factor is administered within about 1 day of healing. In another embodiment, the EGF protein, EGF receptor, nucleotide, compound, or factor is administered according to any of the timing embodiments enumerated herein for Dkk1 protein. Each possibility represents a separate embodiment of the present invention.

In another embodiment, the present invention provides a use of either: (i) an EGF protein; (ii) an EGF receptor; (iii) a nucleotide encoding an EGF protein or EGF receptor; or (iv) a compound or factor that activates a EGF protein or EGF receptor, for the preparation of a pharmaceutical composition for use in a method for removal of an HF from a skin or scalp of a subject, the method comprising the steps of: (a) disrupting an epidermis of the scalp, eyebrow, or scarred region; and (b) contacting the scalp, eyebrow, or scarred region with the EGF protein, EGF receptor, nucleotide, compound, or factor.

In another embodiment, a composition or method of the present invention is utilized on human skin. In another embodiment, the composition or method is utilized on an area of unwanted hair growth. In another embodiment, the area is the face. In another embodiment, the area is the bikini area. In another embodiment, the area is the legs. In another embodiment, the area is the arms. In another embodiment, the area is the chest.

An "inhibitor" utilized in methods and compositions of the present invention is, in another embodiment, an antibody that binds the protein or biological factor that is the target of the inhibitor. In another embodiment, the inhibitor is a pharmacologic inhibitor. In another embodiment, the inhibitor is any other type of inhibitor known in the art. Each possibility represents a separate embodiment of the present invention.

The step of disrupting the epidermis in methods of the present invention is performed, in another embodiment, by abrading the scalp, eyebrow, or scarred region. In another embodiment, the term "abrading" refers to an act of creating an abrasion. In another embodiment, "abrading" refers to rubbing. In another embodiment, "abrading" refers to wearing away by friction. As provided herein (Example 1), epidermal abrasion causes, under the conditions utilized herein, de novo HF neo-genesis. In another embodiment, the epidermal layer is disrupted.

In one embodiment, "abrasion" has the same meaning as "abrading." In another embodiment, "abrasion" refers to an area of the scalp or skin from which the epidermis is removed. In another embodiment, "abrasion" refers to an area of the scalp or skin from which the epidermis and dermis are removed. Each definition of "abrading" and "abrasion" represents a separate embodiment of the present invention.

As provided herein, under the conditions utilized, epidermal disruption by a method of the present invention converts the skin back, in another embodiment, to an embryonic-like state, in which the follicle regenerates. In another embodiment, a subsequent window of opportunity is created, during which the number and size of new HF in the skin can be manipulated. In another embodiment, the administration of a compound or factor that promotes a differentiation of an uncommitted epidermal cell into a HF cell during this window causes regeneration of larger and more numerous HF. The morphology of HF in abraded skin is similar to that of embryonic HF (Example 1-2 and subsequent Examples), and the markers expressed are similar as well.

In another embodiment, the present invention provides a method of stimulating hair growth in a scalp, eyebrow, or scarred region of a subject, comprising performing a method of present invention, thereby stimulating hair growth in a scalp, eyebrow, or scarred region of a subject. As demonstrated in Example 3, EDIHN-induced HF are capable of generating hairs. Thus, methods of the present invention can be used to stimulate hair growth.

"EDIHN," in another embodiment, refers to HF neogenesis induced by disruption of the epithelial layer. In another embodiment, the term refers to HF neogenesis induced by abrasion. In another embodiment, the term refers to HF neogenesis induced by wounding. In another embodiment, the term refers to HF neogenesis induced by disruption of the epithelial layer, followed by administration of a compound or factor that promotes a differentiation of an uncommitted epidermal cell into a HF cell. Each possibility represents a separate embodiment of the present invention.

In another embodiment, the present invention provides a method of testing an ability of a compound to modulate HF generation in vivo, comprising (a) disrupting an epithelial layer of a first scalp, eyebrow, or scarred region, whereby the first scalp, eyebrow, or scarred region has been contacted with the compound; (b) measuring a first HF generation in the first scalp, eyebrow, or scarred region; (c) disrupting an epithelial layer of a second scalp, eyebrow, or scarred region, wherein the second scalp, eyebrow, or scarred region is a scalp, eyebrow, or scarred region of the first subject or a second subject, whereby the second scalp, eyebrow, or scarred region has not been contacted with the compound; (d) measuring a second HF generation in the second scalp, eyebrow, or scarred region; and (e) comparing the first HF generation to the second HF generation, whereby a difference between the first HF generation and the second HF generation indicates that the compound modulates an HF generation in vivo (Examples).

In another embodiment, the present invention provides a method of testing an ability of a compound to stimulate hair growth in vivo, comprising disrupting an epithelial layer of a first scalp, eyebrow, or scarred region, whereby the first scalp, eyebrow, or scarred region has been contacted with the compound; measuring a first HF generation in the first scalp, eyebrow, or scarred region; disrupting an epithelial layer of a second scalp, eyebrow, or scarred region, whereby the second scalp, eyebrow, or scarred region has not been contacted with the compound; measuring a second HF generation in the second scalp, eyebrow, or scarred region; and comparing the first HF generation to the second HF generation, whereby a difference between the first HF generation and the second HF generation indicates that the compound stimulates a hair growth in vivo.

In one embodiment, the methods of the present invention of testing a compound are repeated using a plurality of subjects, until a statistically significant sample has been tested.

In another embodiment of methods for testing compounds of the present invention, the first scalp, eyebrow, or scarred region is a scalp, eyebrow, or scarred region of a first subject. In another embodiment, the subject is a subject in need of generation of a new HF. The second scalp, eyebrow, or scarred region, in another embodiment, is a scalp, eyebrow, or scarred region of the first subject. In another embodiment, the second scalp, eyebrow, or scarred region is a scalp, eyebrow, or scarred region of a second subject. Each possibility represents a separate embodiment of the present invention.

In another embodiment, the excisional wounds of methods of the present invention are created using a surgical tool. In one embodiment, the surgical tool is a dermal biopsy punch (Example 2). In another embodiment, the excisional wounds are induced by freezing or cryoinjury. The use of freezing or cryoinjury is well known in the art, and is used, for example by dermatologists to injure skin. In one embodiment, the freezing or cryoinjury results in a blister. In another embodiment, the blister is used as a "chamber" to introduce drugs and or cells into the reepithelialized area. Each possibility represents a separate embodiment of the present invention.

In another embodiment, the excisional wounds of methods of the present invention are not surgically closed. In another embodiment, the excisional wounds are not contacted with a bandage or dressing before they heal or during a period of time after wound induction. In another embodiment, the excisional wounds are not contacted with an ointment before they heal or during a period of time after wound induction. In another embodiment, the excisional wounds are allowed to heal by secondary intention. Each possibility represents a separate embodiment of the present invention.

The subject of methods of the present invention, is, in another embodiment, a human. As provided herein (Example 7) human skin responds to EDIHN in the same manner as mouse skin. In another embodiment, the subject is a male. In another embodiment, the subject is a female. In another embodiment, the subject is any other type of subject known in the art. Each possibility represents a separate embodiment of the present invention.

In another embodiment, the subject is an adult. In one embodiment, "adult" refers to an age greater than about 18 years. In another embodiment, "adult" refers to an age greater than about 20 years. In another embodiment, "adult" refers to an age greater than about 25 years. In another embodiment, "adult" refers to an age greater than about 30 years. In another embodiment, "adult" refers to an age greater than about 35 years. In another embodiment, "adult" refers to an age greater than about 40 years. In another embodiment, "adult" refers to an age greater than about 45 years.

In another embodiment, the subject is elderly. In one embodiment, "elderly" refers to an age greater than about 45 years. In another embodiment, "elderly" refers to an age greater than about 50 years. In another embodiment, "elderly" refers to an age greater than about 55 years. In another embodiment, "elderly" refers to an age greater than about 60 years. In another embodiment, "elderly" refers to an age greater than about 65 years. In another embodiment, "elderly" refers to an age greater than about 70 years.

In another embodiment, the first subject, or, where applicable, both the first subject and the second subject, is a laboratory animal. In another embodiment, the subject(s) is/are mice. In another embodiment, the subject(s) is/are rats. In another embodiment, the subject(s) is/are gerbils. In another embodiment, the subject(s) is/are hamsters. In another embodiment, the subject(s) is/are guinea pigs. In another embodiment, the subject(s) is/are rabbits. In another embodiment, the subject(s) is/are pigs. In another embodiment, the subject(s) is/are dogs. In another embodiment, the subject(s) is/are cats. In another embodiment, the subject(s) is/are primates. In another embodiment, the subject(s) is/are any other laboratory animal known in the art. Each possibility represents a separate embodiment of the present invention.

In another embodiment, the subject(s) has a disease or disorder comprising balding. In another embodiment, the subject(s) does not have a disease or disorder comprising balding. In another embodiment, the disease or disorder is androgenetic alopecia (AGA). In another embodiment, the disease or disorder is male pattern baldness. In another embodiment, the disease or disorder is female pattern baldness. In another embodiment, the disease or disorder is a discoid lupus erythematosis. In another embodiment, the disease or disorder is a congenital hypotrichosis. In another embodiment, the disease or disorder is a lichen planopilaris. In another embodiment, the disease or disorder is a scarring alopecia. In another embodiment, the disease or disorder is any other disease or disorder comprising balding known in the art.

In another embodiment, the scalp, eyebrow, or scarred region(s) has a majority of HF in the telogen stage of the hair cycle. The findings of Examples 5-6 show that (a) EDIHN can restore hair growth to the scalp, eyebrow, or scarred region at the telogen stage; and (b) the efficiency of EDIHN at the telogen stage can be enhanced by depilation prior to abrasion or wound induction. In another embodiment, the scalp, eyebrow, or scarred region(s) has more than about 60% of HF in the telogen stage of the hair cycle. In another embodiment, the scalp, eyebrow, or scarred region(s) has more than about 70% of HF in the telogen stage of the hair cycle. In another embodiment, the scalp, eyebrow, or scarred region(s) has more than about 80% of HF in the telogen stage of the hair cycle. In another embodiment, the scalp, eyebrow, or scarred region(s) has more than about 90% of HF in the telogen stage of the hair cycle. In another embodiment, the scalp, eyebrow, or scarred region(s) does not have a majority of HF in the telogen stage of the hair cycle. Each possibility represents a separate embodiment of the present invention.

In another embodiment of methods and compositions of the present invention, the first step (e.g. epithelial disruption) is performed 3-12 days prior to the second step (e.g. addition of an active compound, factor, cell, etc). In another embodiment, the interval is 4-12 days. In another embodiment, the interval is 5-12 days. In another embodiment, the interval is 4-11 days. In another embodiment, the interval is 6-11 days. In another embodiment, the interval is 6-10 days. In another embodiment, the interval is 6-9 days. In another embodiment, the interval is 6-8 days. In another embodiment, the interval is 7-8 days. In another embodiment, the interval is 5-11 days. In another embodiment, the interval is 5-10 days. In another embodiment, the interval is 7-10 days. In another embodiment, the interval is about 1 week. Each possibility represents a separate embodiment of the present invention.

In another embodiment, a method of the present invention further comprises the step of suppressing an activity or expression of a Wnt protein in the scalp, eyebrow, or scarred region. As provided herein, suppressing Wnt activity induces pigmentation in HF generated by methods of the present invention. In another embodiment, the step of suppressing Wnt activity or expression is performed within about 10 days of epidermal disruption. In another embodiment, the step of suppressing Wnt activity or expression is performed prior to the second step (e.g prior to addition of a compound or factor that promotes HF cell differentiation. Each possibility represents a separate embodiment of the present invention.

In another embodiment, the present invention provides a method for inducing pigmentation of a hair, comprising suppressing expression of a Wnt protein in a follicle of the hair. In another embodiment, the Wnt protein is Wnt1. In another embodiment, the Wnt protein is a Wnt7. In another embodiment, the Wnt protein is a Wnt7a. In another embodiment, the Wnt protein is a Wnt3. In another embodiment, the Wnt protein is a Wnt3a. In another embodiment, the Wnt protein is a Wnt10. In another embodiment, the Wnt protein is a Wnt10a. In another embodiment, the Wnt protein is any other Wnt protein known in the art. Each possibility represents a separate embodiment of the present invention.

In another embodiment, the present invention provides a method for inducing growth of a pigmented scalp hair or eyebrow of a subject, comprising generating a hair follicle in the scalp, eyebrow, or scarred region according to a method of the present invention and suppressing expression of a Wnt protein in the hair follicle, thereby inducing a growth of a pigmented scalp hair or eyebrow of a subject.

In another embodiment, the step of suppressing expression of a Wnt protein comprises inducing an expression of a Dkk1 protein. In another embodiment, the step of suppressing expression of a Wnt protein comprises inducing an expression of any other Wnt inhibitor known in the art. In another embodiment, the step of suppressing expression of a Wnt protein is performed immediately or shortly after epidermal disruption. In another embodiment, the step of inducing expression of a Dkk1 protein is performed immediately or shortly after epidermal disruption. In another embodiment, the step of suppressing expression of a Wnt protein is performed at the time of epidermal disruption. In another embodiment, the step of inducing expression of a Dkk1 protein is performed at the time of epidermal disruption. In another embodiment, the step of suppressing expression of a Wnt protein is performed several days before generation of the follicle. In another embodiment, the step of inducing expression of a Dkk1 protein several days before generation of the follicle. Each possibility represents a separate embodiment of the present invention.

In another embodiment, the step of suppressing expression of a Wnt protein is performed for about 8 days. In another embodiment, the step of inducing expression of a Dkk1 protein is performed for about 8 days. In another embodiment, the step of suppressing expression of a Wnt protein is performed for about 9 days. In another embodiment, the step of inducing expression of a Dkk1 protein is performed for about 9 days. In another embodiment, the step of suppressing expression of a Wnt protein is performed for about 10 days. In another embodiment, the step of inducing expression of a Dkk1 protein is performed for about 10 days. In another embodiment, the step of suppressing expression of a Wnt protein is performed for about 12 days. In another embodiment, the step of inducing expression of a Dkk1 protein is performed for about 12 days. In another embodiment, the step of suppressing expression of a Wnt protein is performed during the period of re-epithelialization. In another embodiment, the step of inducing expression of a Dkk1 protein is performed during the period of re-epithelialization. In another embodiment, expression of a Dkk1 protein is halted after several days. In another embodiment, halting expression of Dkk1 protein after several days induces, or enables induction of Wnt protein expression. In another embodiment, the expression of a Wnt protein is induced about 9 days after the abrating or wounding. In another embodiment, the expression of a Wnt protein is induced following the period of re-epithelialization. In another embodiment, induction of Wnt protein expression is necessary for formation of new HF. Each possibility represents a separate embodiment of the present invention.

In another embodiment, "several" refers to about 1 day. In another embodiment, "several" refers to about 2 days. In another embodiment, "several" refers to about 3 days. In another embodiment, "several" refers to about 5 days. In another embodiment, "several" refers to about 7 days. In another embodiment, "several" refers to about 10 days. In another embodiment, "several" refers to about 12 days. Each possibility represents a separate embodiment of the present invention.

In another embodiment, the step of contacting in methods of the present invention comprises directly contacting the scalp, eyebrow, or scarred region with the compound, RNA, protein, etc. In another embodiment, the step of contacting comprises indirectly contacting the scalp, eyebrow, or scarred region via contacting another site or tissue of the subject, after which the compound, RNA, or protein is transported to the scalp, eyebrow, or scarred region by a biological process; e.g., diffusion, active transport, or circulation in a fluid such as the blood, lymph, interstitial fluid, etc. Each possibility represents a separate embodiment of the present invention.

In another embodiment, the epidermal disruption in methods of the present invention further removes dermal tissue from the scalp, eyebrow, or scarred region. In another embodiment, the epidermal disruption does not remove dermal tissue from the scalp, eyebrow, or scarred region. Each possibility represents a separate embodiment of the present invention.

"Disrupting" an epidermis or epidermal layer refers, in another embodiment, to removing part of the epidermis or epidermal layer. In another embodiment, the term refers to disturbing the intactness of the epidermis or epidermal layer. In another embodiment, the term refers to perforating the epidermis or epidermal layer. In another embodiment, only part of the epidermal layer need be removed. In another embodiment, the entire epidermal layer is removed. In another embodiment, the term refers to abrading the epidermis or epidermal layer (Examples). In another embodiment, the term refers to wounding the epidermis or epidermal layer (Examples). Each possibility represents a separate embodiment of the present invention.

In another embodiment, the epidermal disruption is performed with a tool that comprises sandpaper. In another embodiment, the epidermal disruption is performed with a laser. In another embodiment, the laser is a Fraxel laser. In another embodiment, the laser is a $CO_2$ laser. In another embodiment, the laser is an excimer laser. In another embodiment, the laser is any other type of laser capable of inducing trans-epithelial injury. In another embodiment, the epidermal disruption is performed with a felt wheel. In another embodiment, the epidermal disruption is performed with a surgical tool. In another embodiment, the epidermal disruption is performed with any other tool known in the art that is capable of epidermal disruption. In another embodiment, the epidermal disruption comprises use of a micro-dermabrasion device. In another embodiment, the epidermal disruption comprises a burn treatment.

In another embodiment, the epidermal disruption comprises a disruption of a follicle of said epidermis and a disruption of an interfollicular region of said epidermis. In another embodiment, the epidermal disruption comprises a disruption of a follicle of said epidermis and does not comprise a disruption of an interfollicular region of said epidermis. Each possibility represents a separate embodiment of the present invention.

In another embodiment, the epidermal disruption comprises a light-based method. In another embodiment, the epidermal disruption comprises irradiation with visible light. In another embodiment, the epidermal disruption comprises irradiation with infrared light. In another embodiment, the epidermal disruption comprises irradiation with ultraviolet radiation. In another embodiment, the epidermal disruption comprises orthovoltage irradiation. In another embodiment, the epidermal disruption comprises X-ray irradiation. In another embodiment, the epidermal disruption comprises any other type of irradiation known in the art.

In another embodiment, the epidermal disruption is performed by mechanical means. In another embodiment, "mechanical means" refers to abrading. In another embodiment, the term refers to wounding. In another embodiment, the term refers to ultrasound. In another embodiment, the term refers to radio-frequency. In another embodiment, the term refers to ab electrical process or the use of an electrical current. In another embodiment, the term refers to electoporation. In another embodiment, the term refers to exision. In another embodiment, the term refers to tape-stripping. In another embodiment, the term refers to microdermabrasion. In another embodiment, the term refers to the use of peels. In another embodiment, the term refers to any other type of mechanical means known in the art. Each possibility represents a separate embodiment of the present invention.

In another embodiment, the epidermal disruption comprises chemical treatment. In another embodiment, the chemical is phenol. In another embodiment, the chemical is trichloracetic acid. In another embodiment, the chemical is ascorbic acid. In another embodiment, the chemical is any other chemical capable of epidermal disruption that is known in the art.

Each method or type of method of epidermal disruption represents a separate embodiment of the present invention.

In another embodiment, epidermal trauma is utilized in a method of the present invention.

Each type of epidermal abrasion and epidermal trauma represents a separate embodiment of the present invention.

In another embodiment, the epidermal disruption of methods of the present invention creates an abrasion at least about 1-1.5 centimeters (cm) in width. In another embodiment, the abrasion is at least about 1 cm in width. In another embodiment, the abrasion is at least about 1.5 cm in width. In another embodiment, the abrasion is at least about 2 cm in width. Each type of abrasion represents a separate embodiment of the present invention.

In another embodiment, the scalp, eyebrow, or scarred region is not contacted with a bandage or dressing following the epidermal disruption. In another embodiment, the scalp, eyebrow, or scarred region is not contacted with an ointment following the epidermal disruption. In another embodiment, the scalp, eyebrow, or scarred region is allowed to heal for a period of time without being contacted by any substance, device, ointment, etc., that is ordinarily administered to an abrasion or wound to facilitate healing. In another embodiment, the scalp, eyebrow, or scarred region is allowed to heal for a period of time without being contacted by any substance, device, ointment, etc., that is ordinarily administered to an abrasion or wound to prevent infection. In another embodiment, the period of time is the time it takes the epidermal disruption to heal. In another embodiment, the period of time is any time or range of times between 2 days and 3 weeks. Each possibility represents a separate embodiment of the present invention.

In one embodiment, "following" refers to a period of time of about 2 days. In another embodiment, "following" refers to a period of time of about 3 days. In another embodiment, "following" refers to a period of time of about 4 days. In another embodiment, "following" refers to a period of time of about 5 days. In another embodiment, "following" refers to a period of time of about 7 days. In another embodiment, "following" refers to a period of time of about 10 days. In another embodiment, "following" refers to a period of time of about 2 weeks. In another embodiment, "following" refers to a period of time of about 3 weeks. Each possibility represents a separate embodiment of the present invention.

In another embodiment, a method of the present invention further comprises the step of depilating the scalp, eyebrow, or scarred region. As provided herein, the findings of Example 6 show that the efficiency of EDIHN can be enhanced by depilation prior to abrasion or wound induction.

In another embodiment, the depilation is epilation. In another embodiment, the depilation comprises the step of waxing. In another embodiment, the depilation comprises the step of plucking. In another embodiment, the depilation comprises the use of an abrasive material. In another embodiment, the depilation comprises the use of a laser. In another embodiment, the depilation comprises the use of electrolysis. In another embodiment, the depilation comprises the use of a mechanical device. In another embodiment, the depilation comprises the use of thioglycolic acid. In another embodiment, the depilation comprises the use of any other method of depilation or epilation known in the art. Each possibility represents a separate embodiment of the present invention.

In another embodiment, a method of the present invention further comprises the step of administering a topical retinoid to the scalp, eyebrow, or scarred region. In one embodiment, the topical retinoid induces resting (telogen) HF in the scalp, eyebrow, or scarred region to enter anagen. Each possibility represents a separate embodiment of the present invention.

In another embodiment, the additional step (depilation or administration of a retinoid) is performed prior to the step of disrupting the epidermis. In another embodiment, the additional step is performed following the step of disrupting the epidermis, but prior to the addition of the compound or factor that promotes a differentiation of an uncommitted epidermal cell into a HF cell. In another embodiment, the additional step is performed concurrently with the addition of the differentiation-promoting compound or factor. In another embodiment, the additional step is performed following the addition of the differentiation-promoting compound or factor. Each possibility represents a separate embodiment of the present invention.

In another embodiment, the additional step is performed between about two days and about three weeks before the step of abrading. In another embodiment, the additional step is performed about two days before the step of abrading. In another embodiment, the additional step is performed about three days before the step of abrading. In another embodiment, the additional step is performed about four days before the step of abrading. In another embodiment, the additional step is performed about one week before the step of abrading. In another embodiment, the additional step is performed about ten days before the step of abrading. In another embodiment, the additional step is performed about two weeks before the step of abrading. In another embodiment, the additional step is performed about three weeks before the step of abrading. Each possibility represents a separate embodiment of the present invention.

In another embodiment, the methods of the present invention further comprise the step of contacting the scalp, eyebrow, or scarred region with an inductive cell capable of inducing an epidermal cell to differentiate into an HF cell. In another embodiment, the HF cell is an HF stem cell. Each possibility represents a separate embodiment of the present invention.

In another embodiment, the inductive cell is a dermal papilla cell. In another embodiment, the inductive cell is a follicular papilla cell. In another embodiment, the inductive cell is a dermal sheath cell. In another embodiment, the inductive cell is a cell that has been genetically modified; for example, with a gene encoding a factor that activates one of the proteins or pathways shown in the present invention to be up-regulated in HF stem cells. In one embodiment, the factor is hedgehog. In another embodiment, the factor is a DP cell protein. In another embodiment, the factor is wingless/int (wnt). In another embodiment, the factor is a Noggin protein. In another embodiment, the factor is a bone morphogenic protein (BMP). In another embodiment, the factor is a fibroblast growth factor (FGF). In another embodiment, the factor is a transforming growth factor beta (TGF-beta) protein. In another embodiment, the factor is sonic hedgehog protein. In another embodiment, the factor is a neurotropin. In another embodiment, the factor is any other factor known in the art that can contribute to induction of an epidermal cell to differentiate into an HF cell. Each possibility represents a separate embodiment of the present invention.

In another embodiment, the inductive cell has been genetically modified with a gene encoding a factor that represses one of the proteins or pathways shown in the present invention to be down-regulated in HF stem cells. In another embodiment, the inductive cell has been genetically modified with a gene encoding a factor that activates one of the proteins or pathways shown in the present invention to be up-regulated in HF stem cells upon their activation.

In another embodiment, the inductive cell is an autologous cell. In another embodiment, the inductive cell is an allogenic cell.

In another embodiment, the inductive cell is derived from a mesenchymal stem cell. In another embodiment, the inductive cell is derived from a mesodermal progenitor cell. In another embodiment, the inductive cell is derived from a hematopoietic stem cell. In another embodiment, the inductive cell is derived from an embryonic stem cell. In another embodiment, the inductive cell is derived from an embryonic carcinoma cell. In another embodiment, the inductive cell is one of the cell types disclosed in United States Patent Application No. 2003/0201815. In another embodiment, the inductive cell is any other type of cell known in the art with inductive properties for an epidermal cell. Each type of inductive cell represents a separate embodiment of the present invention.

In another embodiment, the epidermal cell (e.g. the epidermal cell that is induced to differentiate into an HF cell) is an epidermal stem cell. In another embodiment, the epidermal cell is a bulge cell. In another embodiment, the epidermal cell is any other type of cell known in the art that can be induced to differentiate into an HF stem cell. Each possibility represents a separate embodiment of the present invention.

In another embodiment, a method of the present invention further comprises the step of contacting the scalp, eyebrow, or scarred region with an anti-androgen compound. In one embodiment, the anti-androgen compound is finasteride. In another embodiment, the anti-androgen compound is Fluridil®. In another embodiment, the anti-androgen compound is dutasteride. In another embodiment, the anti-androgen compound is spironolactone. In another embodiment, the anti-androgen compound is cyproterone acetate. In another embodiment, the anti-androgen compound is bicalutamide. In another embodiment, the anti-androgen compound is flutamide. In another embodiment, the anti-androgen compound is nilutamide. In another embodiment, the anti-androgen compound is an inhibitor of an androgen receptor. In another embodiment, the anti-androgen compound is any other anti-androgen compound known in the art. Each possibility represents a separate embodiment of the present invention.

In another embodiment, a method of the present invention further comprises the step of contacting the scalp, eyebrow, or scarred region with an estrogen compound. In another embodiment, a method of the present invention further comprises the step of contacting the scalp, eyebrow, or scarred region with an estrogen receptor agonist. In another embodiment, a method of the present invention further comprises the step of contacting the scalp, eyebrow, or scarred region with an estrogen analogue. In one embodiment, the estrogen analogue is estradiol. In another embodiment, the estrogen analogue is 17 beta-estradiol. In another embodiment, the estrogen analogue is 17 alpha-estradiol. In another embodiment, the estrogen analogue is ZYC3. In another embodiment, the estrogen compound, estrogen receptor agonist, or estrogen analogue is any other estrogen compound, estrogen receptor agonist, or estrogen analogue known in the art. Each possibility represents a separate embodiment of the present invention.

In another embodiment, a method of the present invention further comprises the step of contacting the scalp, eyebrow, or scarred region with an inhibitor of an EGF protein. In another embodiment, a method of the present invention further comprises the step of contacting the scalp, eyebrow, or scarred region with an inhibitor of an EGFR. In another embodiment, a method of the present invention further comprises the step of contacting the scalp, eyebrow, or scarred region with a compound that reduces an expression of an EGF protein or an EGFR. Each possibility represents a separate embodiment of the present invention.

In another embodiment, a method of the present invention further comprises the step of contacting the scalp, eyebrow, or scarred region with a Hedgehog protein. In another embodiment, a method of the present invention further comprises the step of contacting the scalp, eyebrow, or scarred region with a nucleotide encoding a Hedgehog protein. In another embodiment, a method of the present invention further comprises the step of contacting the scalp, eyebrow, or scarred region with an activator of a Hedgehog protein. Each possibility represents a separate embodiment of the present invention.

In one embodiment, a scalp is treated by a method of the present invention. In another embodiment, an eyebrow is treated. In another embodiment, any other hair-bearing area or region of the skin is treated. Each possibility represents a separate embodiment of the present invention.

In another embodiment, a method of the present invention further comprises the step of contacting the scalp, eyebrow, or scarred region with a lithium compound. In one embodiment, the lithium compound contains a lithium ion. In another embodiment, the lithium compound contains a lithium atom.

In another embodiment, a method of the present invention further comprises the step of contacting the scalp, eyebrow, or scarred region with (2'Z,3'E)-6-bromoindirubin-3'-oxime (BIO). In another embodiment, a method of the present invention further comprises the step of contacting the scalp, eyebrow, or scarred region with any other compound known in the art that is capable of inducing an epidermal cell to differentiate into an HF stem cell. Each compound represents a separate embodiment of the present invention.

In one embodiment, the compound administered as part of methods of the present invention is administered systemically. In another embodiment, the compound is administered topically. In another embodiment, the compound is administered to the site of the abrasion. In another embodiment, the compound is administered to the site of the wound induction. In another embodiment, the compound is administered to the site of the depilation. In another embodiment, the compound is administered during wound healing. In another embodiment, the compound is administered prior to HF neo-genesis. In another embodiment, the compound is administered during HF neo-genesis. Each possibility represents a separate embodiment of the present invention.

In another embodiment, the present invention provides a method of inducing formation of an HF stem cell, comprising performing a method of the present invention. In another embodiment, the present invention provides a method of inducing formation of a DP cell, comprising performing a method of the present invention. Each possibility represents a separate embodiment of the present invention.

In another embodiment, homologues and variants of transcripts and proteins of the present invention are administered in methods of the present invention. In another embodiment, homologues and variants of transcripts and proteins of the present invention are targeted in methods of the present invention. Each possibility represents a separate embodiment of the present invention.

The terms "homology," "homologous," etc, when in reference to any protein or peptide, refer in one embodiment, to a percentage of amino acid residues in the candidate sequence that are identical with the residues of a corresponding native polypeptide, after aligning the sequences and introducing gaps, if necessary, to achieve the maximum percent homology, and not considering any conservative substitutions as part of the sequence identity. Methods and computer programs for the alignment are well known in the art.

In another embodiment, the term "homology," when in reference to any nucleic acid sequence similarly indicates a percentage of nucleotides in a candidate sequence that are identical with the nucleotides of a corresponding native nucleic acid sequence.

In another embodiment, "homology" refers to identity of greater than 70%. In another embodiment, "homology" refers to identity of greater than 75%. In another embodiment, "homology" refers to identity of greater than 80%. In another embodiment, "homology" refers to identity of greater than 82%. In another embodiment, "homology" refers to identity of greater than 85%. In another embodiment, "homology" refers to identity of greater than 87%. In another embodiment, "homology" refers to identity of greater than 90%. In another embodiment, "homology" refers to identity of greater than 92%. In another embodiment, "homology" refers to identity of greater than 95%. In another embodiment, "homology" refers to identity of greater than 97%. In another embodiment, "homology" refers to identity of greater than 98%. In another embodiment, "homology" refers to identity of greater than 99%. In another embodiment, "homology" refers to identity of 100%.

Protein and/or peptide homology for any amino acid sequence listed herein is determined, in one embodiment, by methods well described in the art, including immunoblot analysis, or via computer algorithm analysis of amino acid sequences, utilizing any of a number of software packages available, via established methods. Some of these packages may include the PASTA, BLAST, MPsrch or Scanps packages, and may employ the use of the Smith and Waterman algorithms, and/or global/local or BLOCKS alignments for analysis, for example. Each method of determining homology represents a separate embodiment of the present invention.

In another embodiment, the present invention provides a kit, comprising a tools and/or a compound suitable for performing a method of the present invention.

In another embodiment, the present invention provides a device, comprising a tool suitable for epidermal disruption and a means of delivering a compound or factor that promotes a differentiation of an uncommitted epidermal cell into a HF cell.

In other embodiments, the present invention provides a method of treating any disease, disorder, or symptom associated with balding. In other embodiments, the present invention provides a method of treating any disease, disorder, or symptom associated with balding. In other embodiments, the present invention provides a method of treating any disease, disorder, or symptom associated with balding. Each disease, disorder, or symptom represents a separate embodiment of the present invention.

Pharmaceutical Compositions

In another embodiment, methods of the present invention comprise administering a pharmaceutical composition comprising the HF stem cell-inducing or -activating compound and/or its analog, derivative, isomer, metabolite, pharmaceutically acceptable salt, pharmaceutical product, hydrate, N-oxide, or any combination thereof; and a pharmaceutically acceptable carrier. Each possibility represents a separate embodiment of the present invention.

The pharmaceutical compositions containing the HF stem cell-inducing or -activating compound can, in another embodiment, be administered to a subject by any method known to a person skilled in the art, such as topically, parenterally, paracancerally, transmucosally, transdermally, intramuscularly, intravenously, intradermally, subcutaneously, intraperitonealy, intraventricularly, intracranially, intravaginally or intratumorally. Each possibility represents a separate embodiment of the present invention.

In another embodiment, the pharmaceutical compositions are administered orally, and are thus formulated in a form suitable for oral administration, i.e. as a solid or a liquid preparation. Suitable solid oral formulations include tablets, capsules, pills, granules, pellets and the like. Suitable liquid oral formulations include solutions, suspensions, dispersions, emulsions, oils and the like. In one embodiment of the present invention, the HF stem cell-inducing or -activating compounds are formulated in a capsule. In another embodiment, the compositions of the present invention comprise, in addition to the HF stem cell-inducing or -activating compound active compound and the inert carrier or diluent, a hard gelating capsule.

In another embodiment, the pharmaceutical compositions are administered topically to body surfaces and are thus formulated in a form suitable for topical administration. Suitable topical formulations include gels, ointments, creams, lotions, drops and the like. For topical administration, the HF stem cell-inducing or -activating compound or its physiologically tolerated derivatives such as salts, esters, N-oxides, and the like are prepared and applied as solutions, suspensions, or emulsions in a physiologically acceptable diluent with or without a pharmaceutical carrier.

In another embodiment, the pharmaceutical compositions are administered by subcutaneous implantation of a pellet. In another embodiment, the pellet provides for controlled release of HF stem cell-inducing or -activating compound agent over a period of time.

For liquid formulations, pharmaceutically acceptable carriers are, in another embodiment, aqueous or non-aqueous solutions, suspensions, emulsions or oils. Examples of non-aqueous solvents are propylene glycol, polyethylene glycol, and injectable organic esters such as ethyl oleate. Aqueous carriers include, in another embodiment, water, alcoholic/aqueous solutions, emulsions or suspensions, including saline and buffered media. Examples of oils are those of petroleum, animal, vegetable, or synthetic origin, for example, peanut oil, soybean oil, mineral oil, olive oil, sunflower oil, and fish-liver oil.

In one embodiment, the pharmaceutical compositions are controlled-release compositions, i.e. compositions in which the HF stem cell-inducing or -activating compound is released over a period of time after administration. Controlled- or sustained-release compositions include, in another embodiment, formulation in lipophilic depots (e.g. fatty acids, waxes, oils). In another embodiment, the composition is an immediate-release composition, i.e. a composition in which all the HF stem cell-inducing or -activating compound is released immediately after administration.

EXPERIMENTAL DETAILS SECTION

Example 1

Depilation and Epidermal Abrasion Causes De Novo Hair Follicle Formation

Materials and Experimental Methods

Depilation and Epidermal Abrasion

Mice were anesthetized with an injection of sodium pentobarbital before the hair on the back was clipped and depilated with Nair (Carter-Wallace, New York, N.Y.), then epidermis was removed using a rotating felt wheel as described by Argyris T, J Invest Dermatol, 75: 360-362, 1980). After scrubbing with 70% ethanol and drying under an incandescent lamp, the basal and supra-basal layers in an area of $(1.5\ cm)^2$ cm of the inter-follicular epidermis were removed by careful abrasion with a felt wheel mounted on a Dremel Moto-tool (Racine, Wis.). After abrasion, the skin was shiny and smooth, and there was no blood. One day later, the abraded area was covered by a fibrin crust, which fell off after 3-7 days, exposing the newly regenerated epidermis. A group of control mice was sacrificed immediately after abrasion to confirm microscopically the complete removal of the inter-follicular epidermis.

Immunohistochemistry

Skin samples were fixed in PBS-buffered 10% formalin. Six-micron thick paraffin sections were cut and stained, where applicable, with antibodies.

BrdU Labeling

The protocol described by Bickenbach and colleagues (Bickenbach et al, Cell Tiss Kinet 19: 325-333, 1986; Bickenbach et al, Exp Cell Res 244, 184-195, 1998) was used. Mice were injected with 50 milligrams per kilogram (mg/kg) bodyweight 5-bromo-2'-deoxyuridine (BrdU) every 12 hours for a total of four injections.

Results

Figure 2:
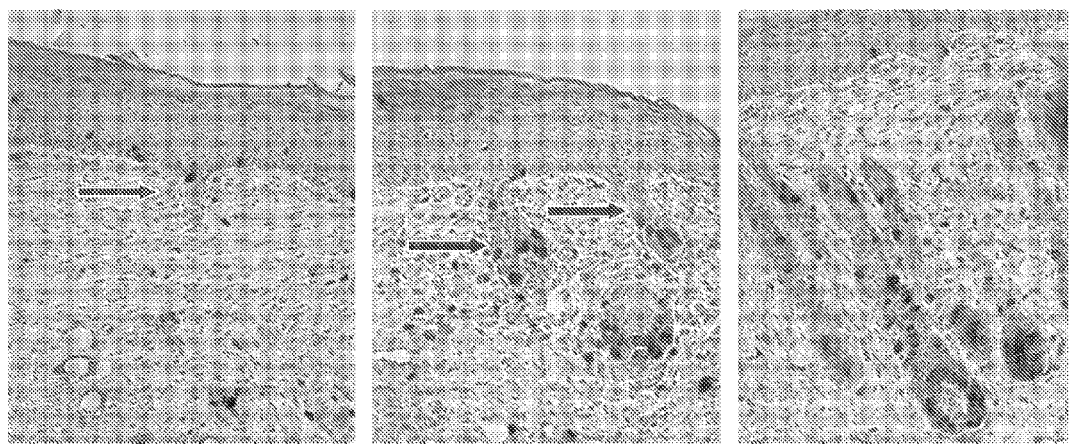
FIG. 2: BrdU labeling of HF following epidermal abrasion. HF at progressive stages of development are depicted in the left, center, and right panels.

An area of the backs of 50-day old mice was subjected to depilation and removal of the epidermis using a rotating felt wheel. Fifteen days later, HF placodes, hair germs and other signs of follicle neogenesis were present (FIG. 1; arrow indicates a hair germ). Morphology of the follicles was similar to embryonic follicle development. To further characterize proliferation in the new follicles, the skin was labeled with BrdU 60 minutes before sacrifice. As depicted in FIG. 2, the proliferation pattern was similar to developing follicles in the embryo.

These findings demonstrate that (a) disruption of the epidermis causes generation of new HF, and that this generation of new HF can occur (b) in adult subjects and (c) during telogen (50-day-old mice are in the second telogen stage of the hair cycle).

Example 2

Induction of a Large Excisional Wound, but not a Small Punch Wound, Causes De Novo Hair Follicle Formation Materials and Experimental Methods Punch Wound and Excisional Wound Induction The backs of 21-day-old mice were depilated as described for Example 1 and sterilized with alcohol, followed by 1% iodine solution. Punch wounds, 4 mm in diameter, were induced using a dermal biopsy punch, down to, but not through, the muscle fascia. Excisional wounds were full thickness and 1 cm in diameter; skin and panniculus carnosus was excised using fine surgical scissors.

Results

Figure 3:
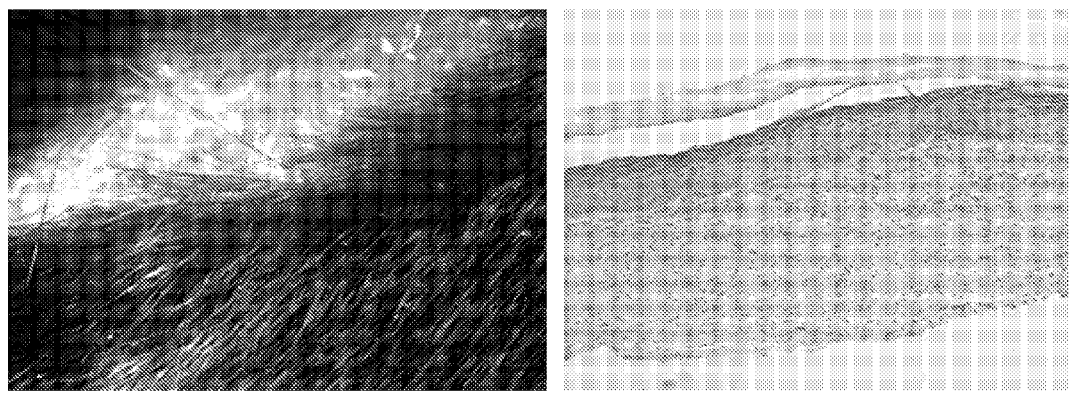
FIG. 3. The wound site did not contain HF immediately after re-epithelialization. Top view (left panel) and tissue section (right panel) of the site 10 days after wound induction.
Figure 4:
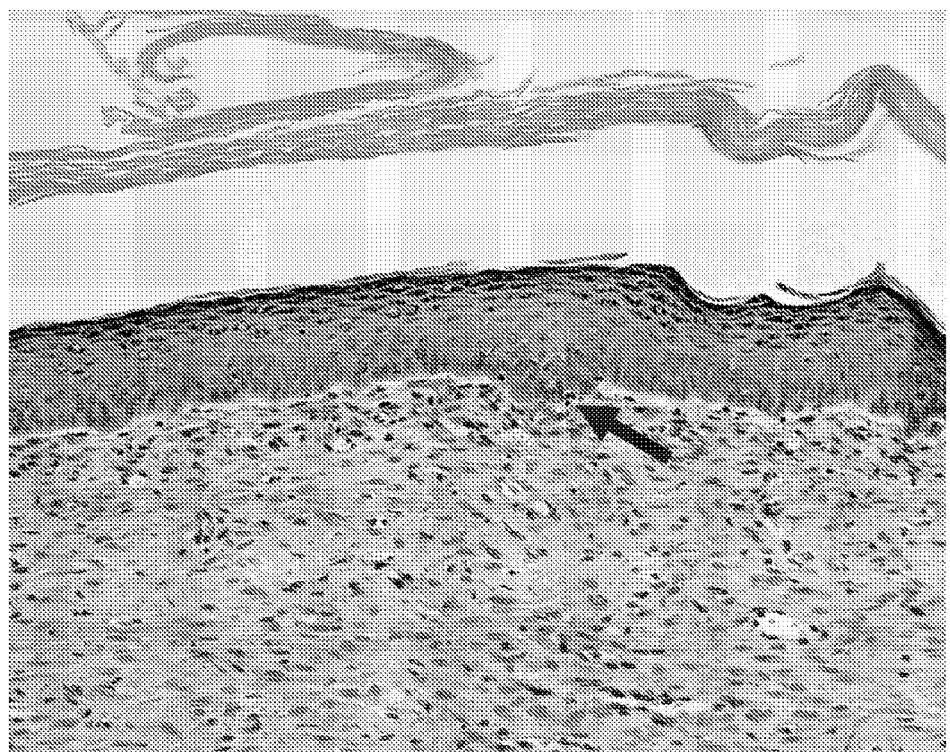
FIG. 4. Appearance of hair germs 12 days after wound induction. Arrow indicates hair germ.
Figure 5:
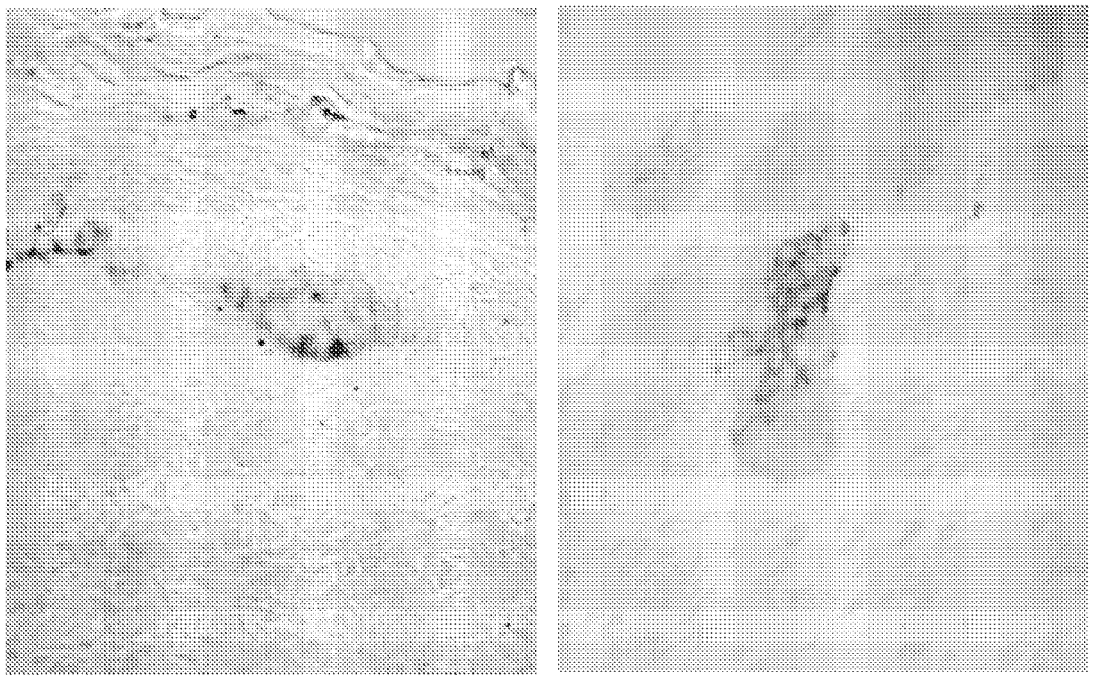
FIG. 5. Epidermal Disruption-Induced HF neogenesis (EDIHN)-induced hair germs express K17. Two different hair germs are depicted in the left and right panels.
Figure 6:
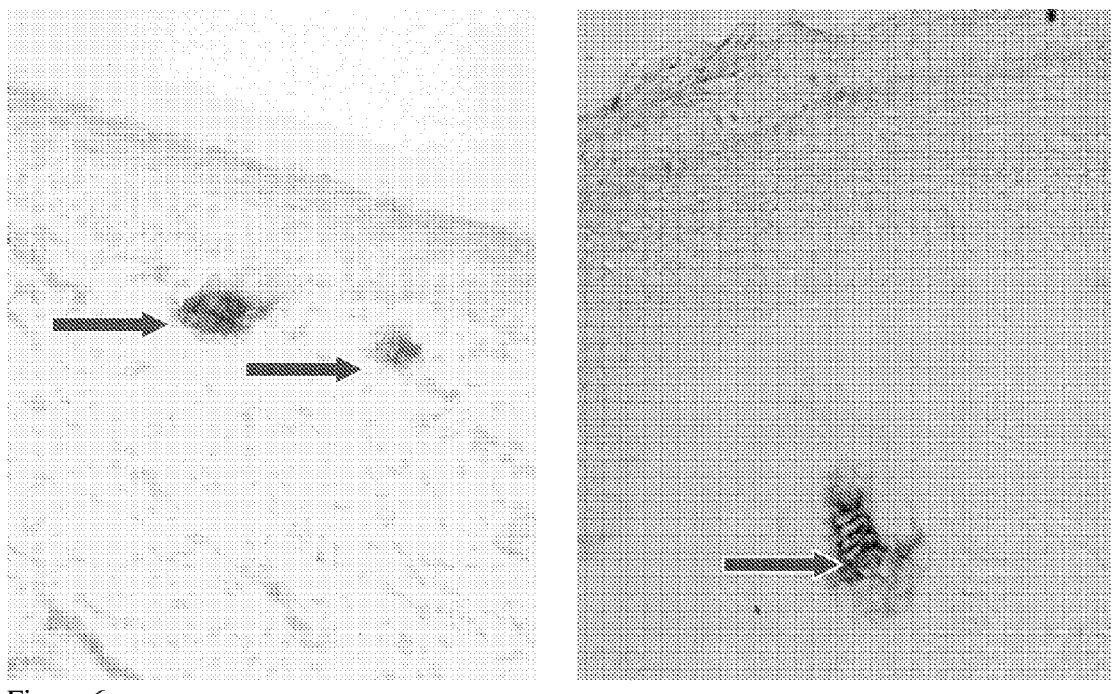
FIG. 6. EDIHN-induced hair germs contain dermal papilla (DP) cells, as evidenced by alkaline phosphatase (AP) staining. Arrows indicate DP cells. Left panel: hair germs. Right panel: HF at a further developmental stage.

To test whether wounding could induce HF formation, punch wounds or excisional wounds were induced in mice. Both types of wounds exhibited contraction and re-epithelialization following wound induction; however, unlike the mice receiving punch wounds, the mice receiving excisional wounds also exhibited scar formation within 10 days of wound induction (FIG. 3, left panel). No follicles were evident at this time point (FIG. 3, right panel). 12 days after wound induction, hair germs, with similar morphology to fetal hair germs, were observed in the wound site, following BrdU pulse labeling (FIG. 4). Several markers were used to verify that the observed structures were HF. The structures exhibited staining with anti-keratin 17 (K17), an HF marker (FIG. 5), and staining with anti-alkaline phosphatase at the 12 day time point verified that the structures had dermal papilli containing fibroblasts, as expected for HF (FIG. 6; HF at earlier and later stages are depicted in the left and right panels, respectively).

Figure 7:
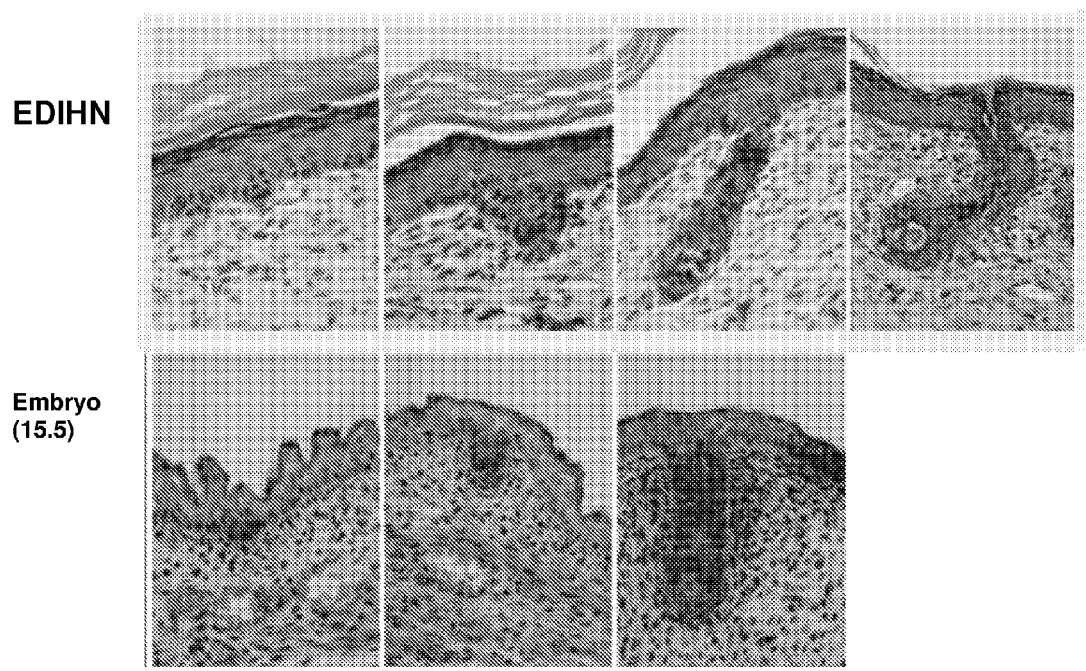
FIG. 7. Histological comparison between EDIHN-induced and embryonic HF. Top left, second from left, third from left, and right panels: Progressive stages of EDIHN-induced HF development. Bottom left, center, and right panels: Progressive stages of and embryonic HF development.
Figure 8:
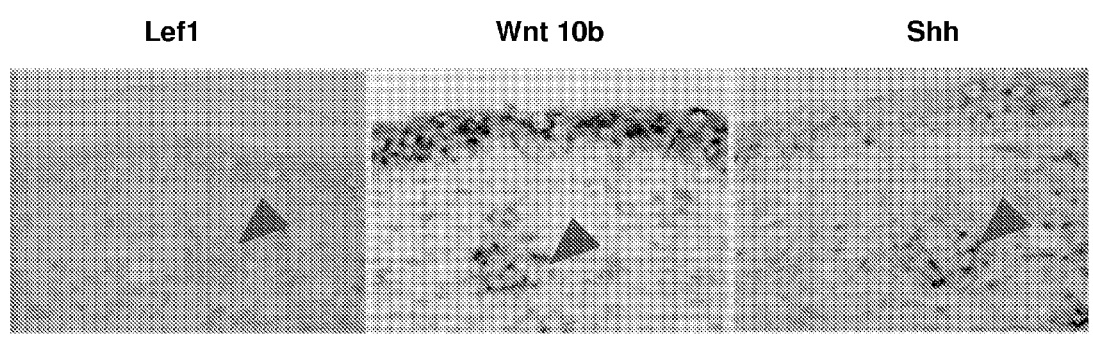
FIG. 8. Induction of several markers of embryonic HF development, Lef1 (left panel), wingless/int (Wnt) 10b (center panel), and sonic hedgehog (Shh; right panel), by EDIHN. HF structures are indicated by arrowheads.
Figure 9:
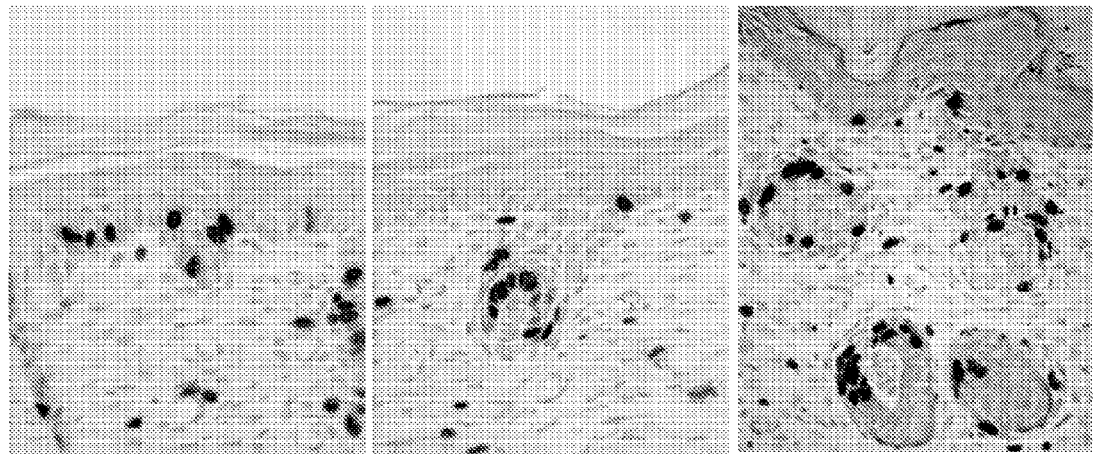
FIG. 9. Proliferative activity during EDIHN, as evidenced by BrdU pulse-labeling. Progressive stages of HF development are depicted in the left, center, and right panels.
Figure 10:
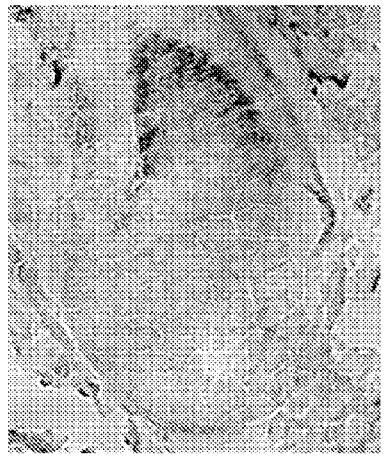
FIG. 10. Induction of HF markers S100A3 (left panel; tissue section parallel to HF axis) and S100A6 (right panel; cross-sectional view of follicle) by EDIHN.
Figure 10:
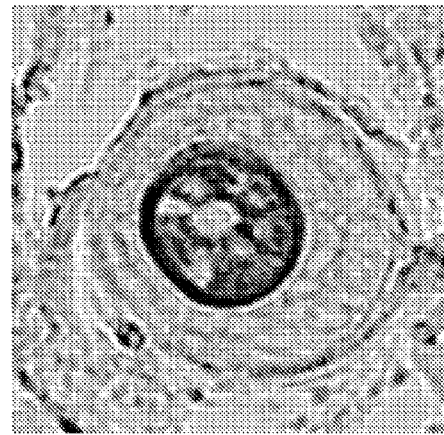

The HF generated by wound induction were further characterized by morphological comparison to embryonic HF, following BrdU staining; a clear correspondence in morphology was observed at various stages (FIG. 7). In addition, several markers of embryonic HF development, namely Lef1, wingless/int (Wnt) 10b, and sonic hedgehog (Shh), were also induced in the epidermal disruption-induced HF neogenesis (EDIHN) (FIG. 8). Additional BrdU staining (FIG. 9) and staining for HF markers S100A3 and S100A6 (FIG. 10; left panel: tissue section parallel to HF axis; right panel: cross-sectional view of follicle) provided further verification that the development of the EDIHN follicles closely paralleled embryonic HF development.

These findings provide further evidence that disruption of the epidermis causes generation of new HF, and that this generation of new HF can occur (b) in adult subjects and (c) during telogen (21-day-old mice are in the first telogen stage of the hair cycle).

Example 3

EDIHN-Induced Hair Follicles Generate Hairs

Figure 11:
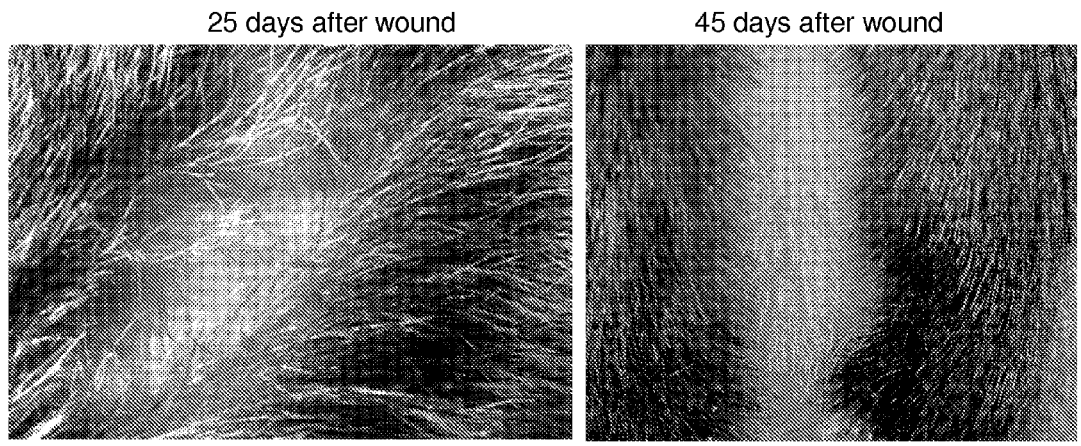
FIG. 11. New hair growth 25 days (left panel) and 45 days (right panel) after wound induction.

At 25 and 45 days after wound induction, wound sites contained new hairs (FIG. 11, left and right panels, respectively). New hairs appeared to lack pigmentation, except when the wnt pathway was inhibited, using Dkk-1 (Dickkopf-1) during the first nine days after wounding (see Example 10).

These findings indicate that EDIHN-induced HF function normally; i.e. are capable of generating hairs.

Example 4

EDIHN Hair Follicles Retain the Ability to Enter into Cyclical Hair Growth

Materials and Experimental Methods

Figure 12:
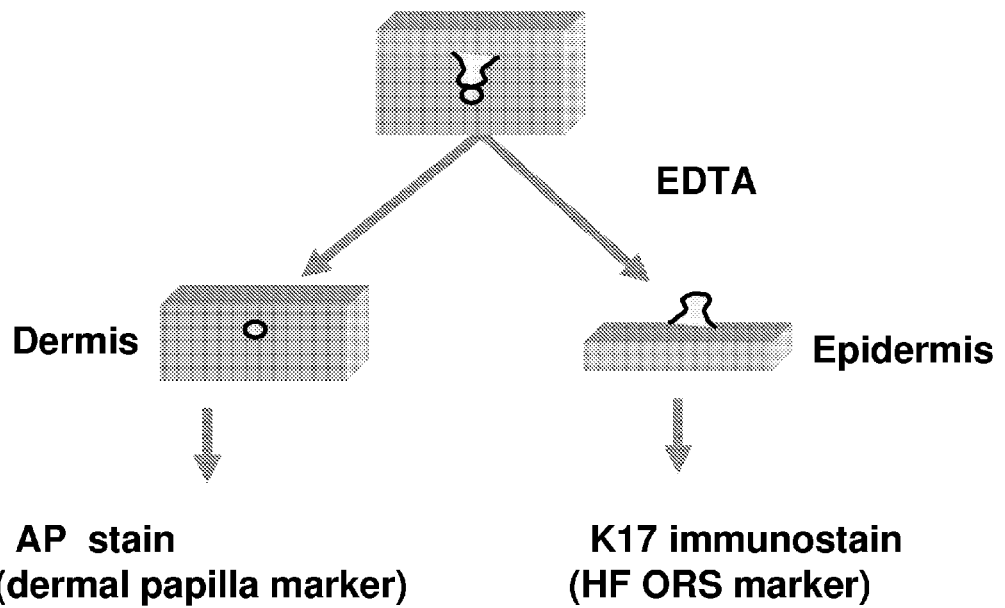
FIG. 12. Schematic of whole-mount EDIHN assay.

BrdU Labeling
50 mg/kg bodyweight BrdU (Sigma) was injected twice per day for 3 days beginning 20 days after wounding. BrdU was detected 40 days after wounding (17 day chase).
Whole Mounting and Immunofluorescence
HF whole mounts were obtained by incubating fresh skin with EDTA (20 mM in PBS) at 37° C. overnight, then separating the epidermis and dermis. Epidermis was then fixed in 10% formalin for 10 min, room temperature (RT). Dermis was fixed in acetone overnight, RT. After rinsing with PBS, whole mounts were stained with antibodies for immunohistochemistry (schematically depicted in FIG. 12) and were imaged using a Leica confocal microscope.

Results

Figure 13:
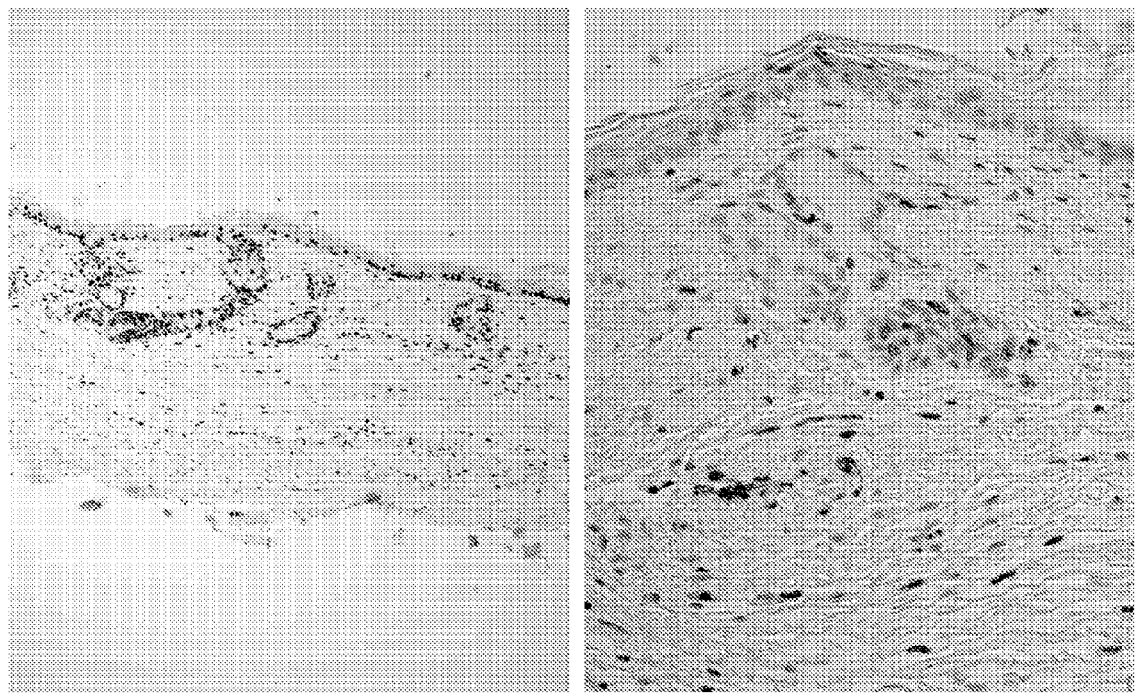
FIG. 13. Repopulation of stem cells in the bulge of EDIHN-induced HF, as evidenced by retention of BrdU label following a chase period. Left panel: lower magnification: 50×. Right panel: higher magnification: 400×.
Figure 14A:
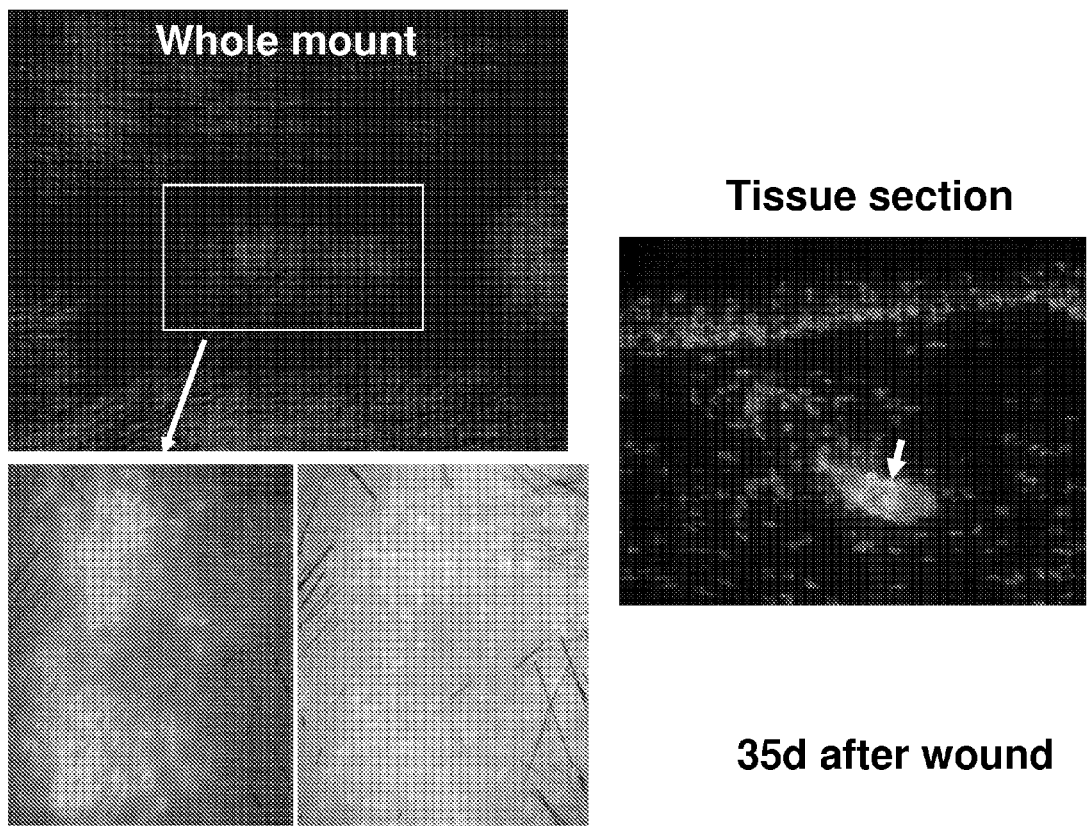
FIG. 14. A. Stem cells in EDIHN-induced HF express K15. Left top panel: Top view of wound site. Bottom, far left panel: epidermis whole mount; bottom, second from left panel: same as [bottom, far left] panel but viewed under white light; right panel: tissue sections. B. Neogenesis HF proceed to next hair cycle.

To determine whether EDIHN-induced HF contain normal levels of HF stem cells, mouse skin was examined for the presence of label-retaining cells at 21 days after wound induction. Retention of BrdU during a long chase period is, under these conditions, one of the hallmarks of HF stem cells. Normal numbers and placement of label-retaining cells (in the bulge of the HF) were observed (FIG. 13). To verify that the label-retaining cells were HF stem cells, K15-eGFP mice were utilized. In these mice, eGFP (enhanced green fluorescent protein) is expressed from the K15 promoter; thus, expression of eGFP identifies HF stem cells. As depicted in FIG. 14A, eGFP-expressing cells were observed in in tissue sections (right side) of newly formed hair follicles 35 days following wound induction. eGFP-expressing cells were also seen in the epidermis whole mounts (bottom, far left panel) indicating the conversion of epidermal cells into cells with hair follicle stem cell characteristics. ([bottom, second from left] panel is same as [bottom, far left] panel but viewed under white light) This finding shows that the observed label-retaining cells exhibited HF stem cell properties.

Figure 14B:

To determine whether EDIHN-induced HF cycle normally, mounts were prepared from additional mice at 35, 38 and 45 days after wounding. As depicted in FIG. 14B, the EDIHN-induced HF entered the resting phase, telogen, and then re-entered a new anagen stage.

Figure 15:
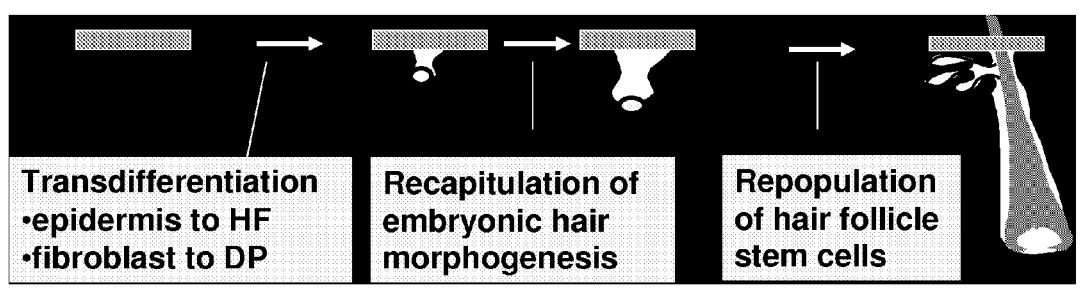
FIG. 15. Schematic of creation of new HF by EDIHN.

In summary, the findings of this Example show that EDIHN-induced HF contain HF stem cells, as do embryonically generated HF. The presence of the HF stem cells shows that EDIHN-induced HF retain the ability to enter into cyclical hair growth in the same manner as embryonically generated HF. The findings also show that wounding induces epidermal cells to assume a hair follicle stem cell state (expressing K15-eGFP). This model is shown schematically in FIG. 15. The findings of Examples 2, 3, and 4 show that EDIHN-induced HF are fully functional and thus able to restore hair growth to a subject in need.

Example 5

EDIHN-Induces New Hair Follicles in Mice at the Telogen Stage of the Hair Cycle

Figure 16:
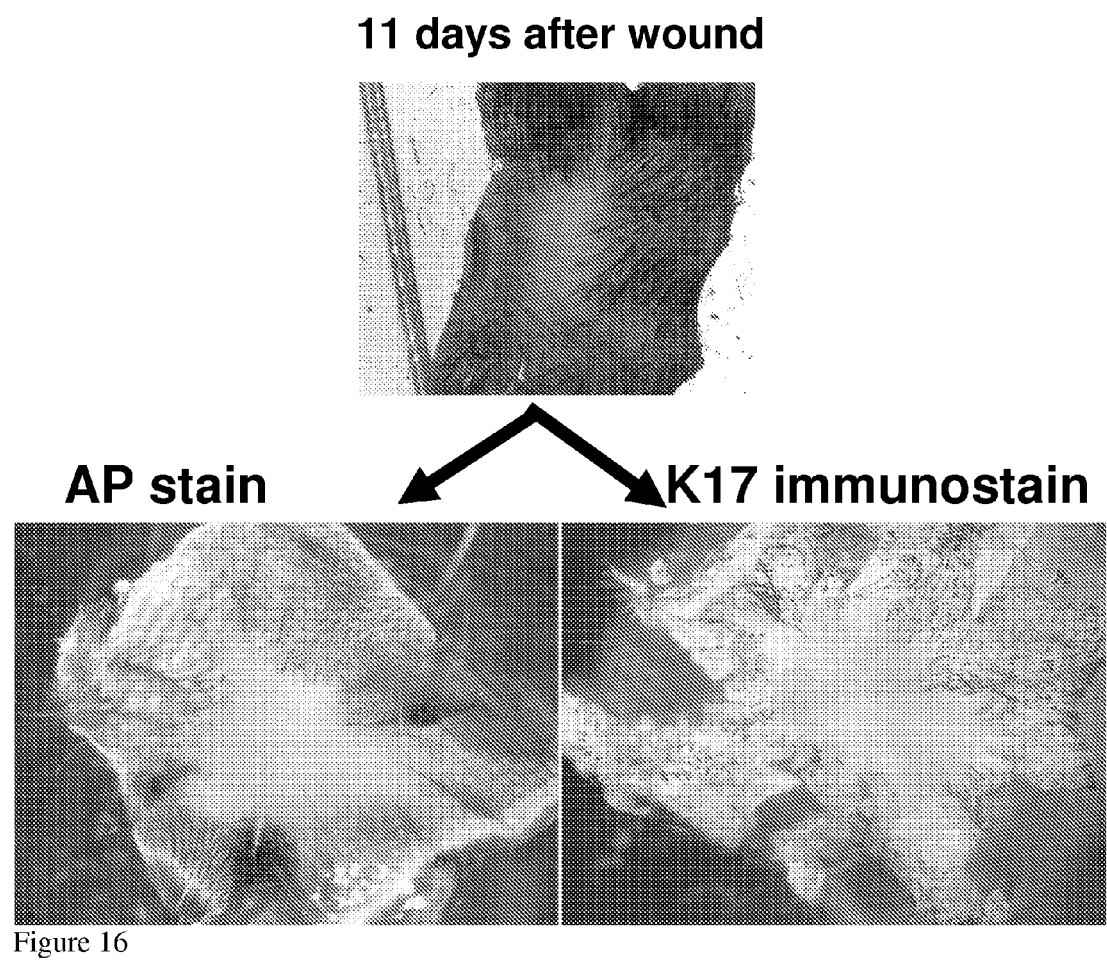
FIG. 16. No new HF are evident 11 days after wound induction in 21-day-old mice. Top panel: macroscopic examination; bottom left panel: AP staining of the dermis; bottom right panel: K17 staining of the epidermis.
Figure 17:
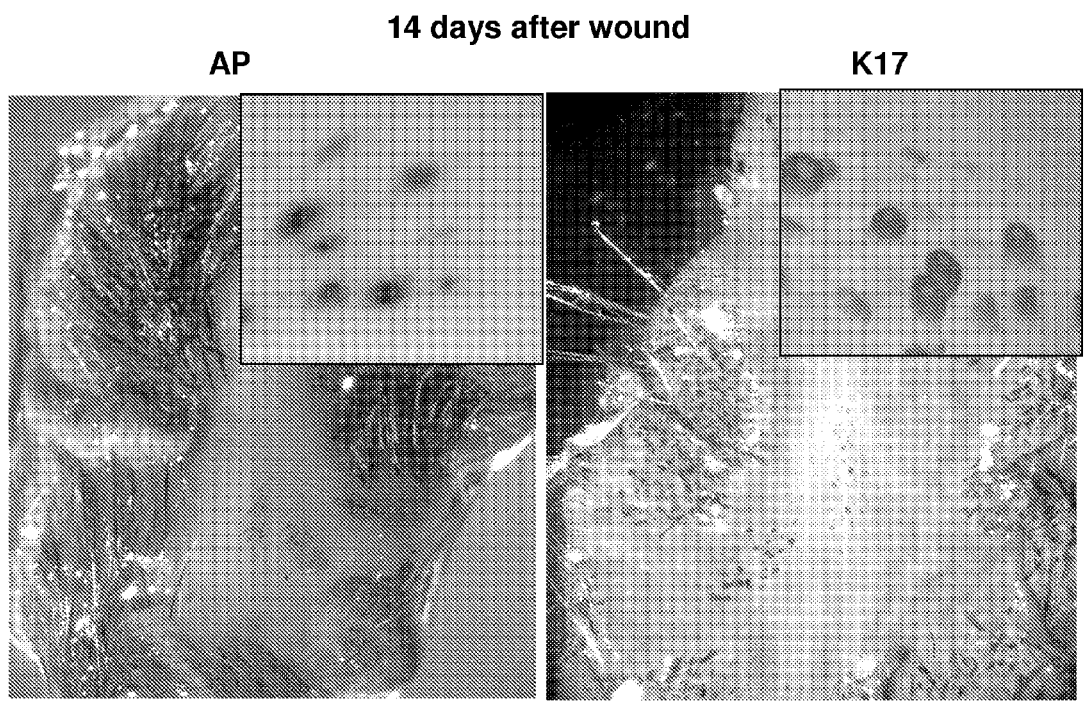
FIG. 17. 14 days after wound induction, new HF have begun to form as evidenced by AP staining of the dermis (left panel) and K17 staining of the epidermis (right panel). Main panels: 10× magnification. Inserts: 80× magnification.
Figure 18:
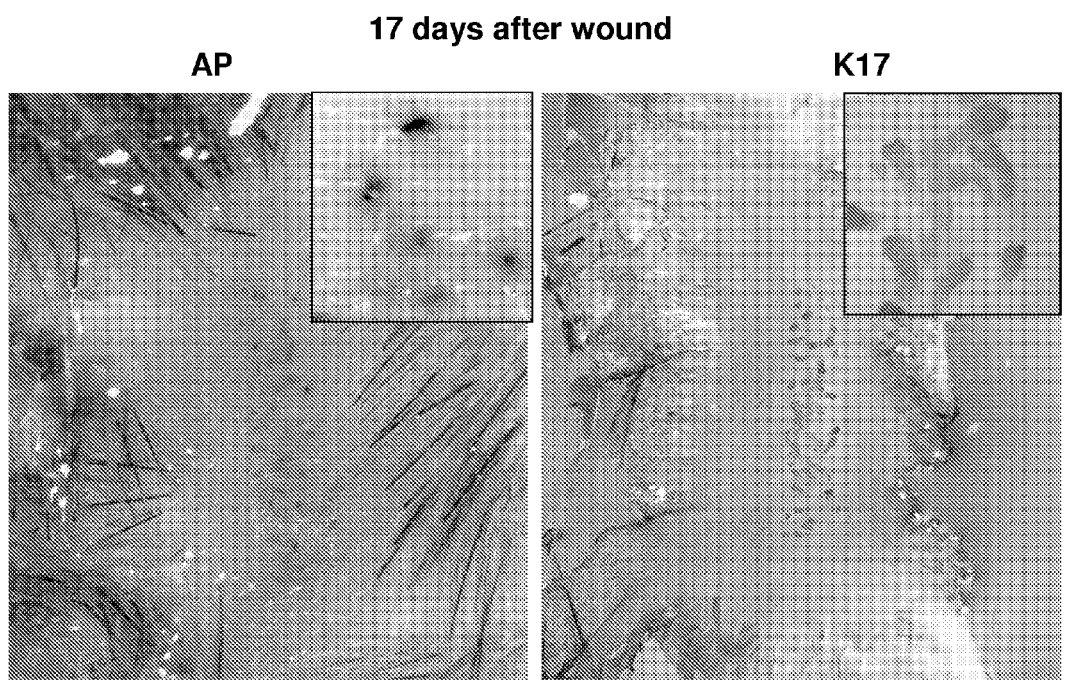
FIG. 18. 17 days after wound induction, new HF are more developed. Left panel: AP staining of the dermis; right panel: K17 staining of the epidermis. Main panels: 10× magnification. Inserts: 80× magnification.

To determine whether EDIHN was induced new hair follicles in mice wounded at the telogen stage of the hair cycle, 21-day-old mice were subjected to EDIHN using a 1-cm excisional wound, as described in Example 2. Skin was then examined by whole-mount assay for indications of new HF. As depicted in FIG. 16, after 11 days, new HF were not evident by macroscopic examination (top panel), AP staining of the dermis (bottom left panel), or K17 staining of the epidermis (bottom right panel). After 14 days, as depicted in FIG. 17, dermal papilla cells were detected in the dermis (left panel) and HF stem cells in the epidermis (right panel), demonstrating that new follicles were being formed. After 17 days, the new follicles were more developed, as shown by examination of the dermis and epidermis (FIG. 18, left and right panels, respectively). This method induced formation of an average of 49 new follicles in the wound, a number that was consistent over three separate experiments, as depicted in Table 1.

TABLE 1

Results of three separate experiments
performed on 21-day-old mice.

| Sample | Expt 1 | Expt 2 | Expt 3 | | |
|---|---|---|---|---|---|
| 1 | 24 | 70 | 55 | | |
| 2 | 29 | 52 | 25 | | |
| 3 | 27 | 85 | 53 | | |
| 4 | 102 | 25 | 80 | | |
| 5 | 53 | 27 | 23 | Avg of expts | Std dev of expts |
| Average | 47 | 51.8 | 47.2 | 48.67 | 2.71 |
| Std dev | 32.8 | 26.3 | 23.7 | | |

The findings of this Example demonstrate that EDIHN is capable of inducing formation of new HF in mice at the telogen stage of the hair cycle, despite that fact that these mice do not contain HF at the anagen stage during wounding.

Example 6

In Adult Mice, Induction of Anagen Increases the Efficiency of EDIHN

The experiment described in Example 5 was repeated with mice of different ages, and therefore at different stages of the hair cycle. To ensure that wound scarring occurred, larger wounds were in induced in the older mice. As depicted in Table 2, adult mice at telogen, such as 8-week-old mice, exhibited lower efficiencies of HF formation by EDIHN.

TABLE 2

Efficiency of HF formation by EDIHN in adult
mice at various stages of the hair cycle.

| Age | Wound size | Days after wound | Mice exhibiting EDIHN | Hair cycle |
|---|---|---|---|---|
| 3 wk | 1 cm | 20 | 25/25 (100%) | Telogen |
| 4 wk | 1 cm | 20 | 5/5 (100%) | Early anagen |
| 5 wk | 1 cm | 20 | 1/2 (50%) | Anagen |
| 8 wk | 1.5 cm | 30 | 16/35 (46%) | Telogen |
| 14 wk | 1.5 cm | 30 | 1/2 (50%) | N/A* |
| 20 wk | 1.5 cm | 30 | 2/2 (100%) | N/A* |

*The second telogen lasts approximately 40 days in mice. Thus, 14-week-old and 20-week-old mice contained a mixture of telogen and anagen HF.

Figure 19:
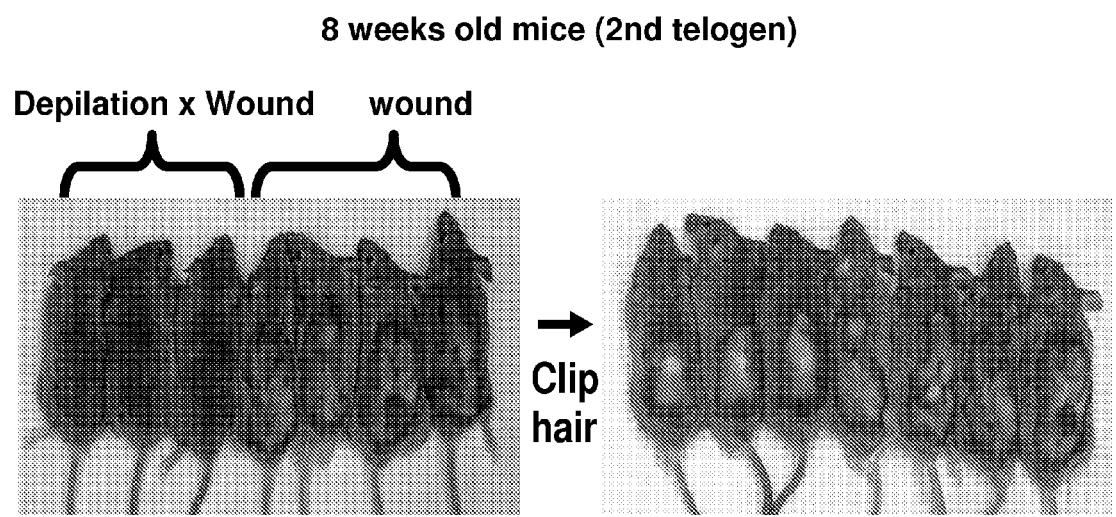
FIG. 19. Wounds closed similar in mice subjected to depilation, then wounding (left 3 mice in each panel) vs. wounding alone (right 4 mice in each panel). Left panel: immediately following wounding. Right panel: 10 days following wounding.
Figure 20:
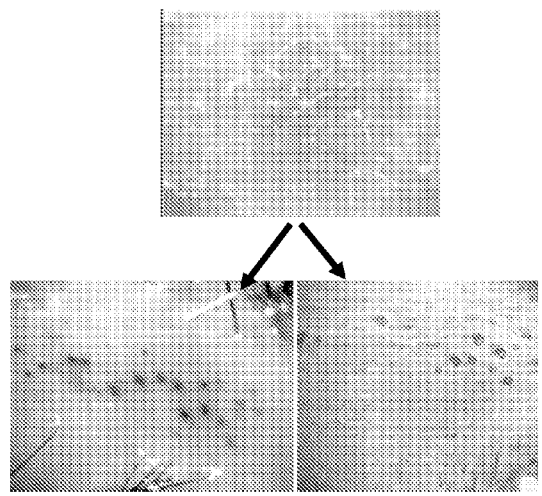
FIG. 20. Anagen induction by depilation prior to wounding enhances the efficiency of EDIHN. A. Top panel: lower left panel AP staining of the dermis; lower right panel: KI 7 staining of the epidermis. B. Graphical representation of enhancement of EDIHN by depilation.
Figure 20:
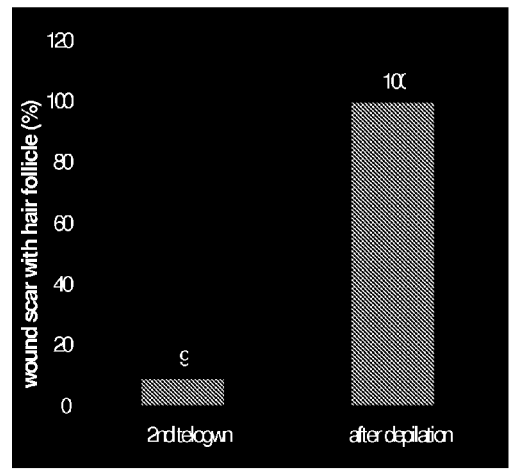

To determine whether experimental induction of anagen increased the efficiency of EDIHN, 8-week-old mice were depilated several days prior to wound induction. As depicted in FIG. 19, the wounds closed similarly whether or not they were preceded by depilation. As depicted in FIG. 20A-B, the depilated mice exhibited enhanced EDIHN relative to the non-depilated mice depicted in the previous Example by a factor of 11-fold.

The findings of this Example demonstrate that anagen induction enhances EDIHN. In addition, these findings show that EDIHN is capable of not only fowling new HF, but also of activating anagen in pre-existing HF in the telogen stage.

Example 7

EDIHN-Induces New Hair Follicles in Human Skin

Materials and Experimental Methods

Grafting

Discarded human adult scalp from the preauricular area obtained from plastic surgery was grafted onto immunodeficient (scid) mice. The graft was bandaged and allowed to heal, then was used in the wound healing study 3 months after grafting.

Results

Figure 21A:
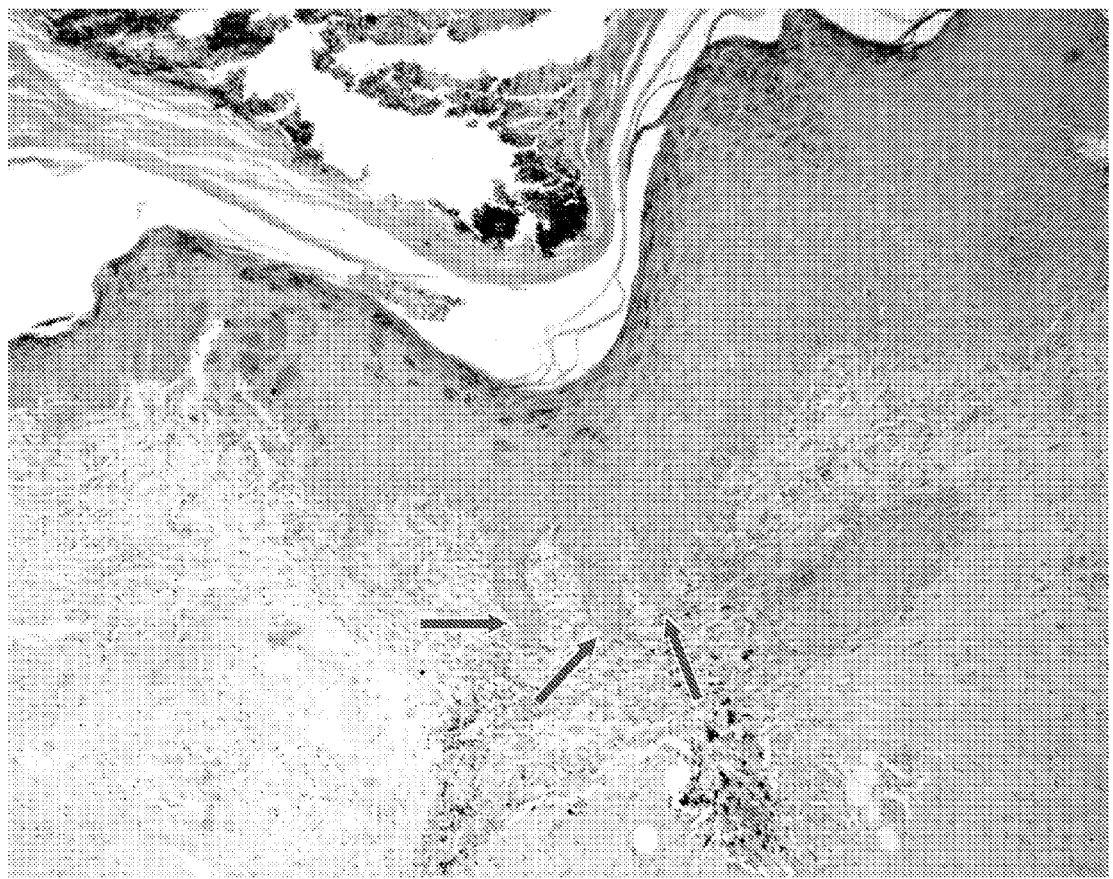
FIG. 21. A. EDIHN in human skin grafted to immunodeficient (scid) mice, seven days after induction of an excisional wound. Arrows indicate new HF. 13. Dermal abrasion of human skin grafts results in EDIHN. Human adult skin (W) was grafted onto mice, abraded, and examined seven days later, by staining for S100A6 (first, second, and fourth rows) or S100A4 (third row). Hair germs (HG) and dermal papilla (DP) are indicated. Human fetal skin (F) with normal developing hair follicles is shown for comparison. Mouse skin 17d post wounding was included as a control (top left panel).

To determine whether human skin responded to EDIHN as did mouse skin, human skin was grafted onto SCID (immunodeficient) mice and subjected to depilation by plucking and wound induction three days later. Seven days following wound induction, formation of new HF was observed in the human skin (FIG. 21A; arrows indicate new HF) by hematoxylin and eosin staining of paraffin embedded tissue sections.

In additional experiments, adult human skin was grafted onto mice, abraded, and examined at 7 days post-abrasion. New HF were generated in the human skin, which mimicked normal hair follicle formation during fetal development, as evidenced by staining for S100A6 or S100A4 (FIG. 21B).

The results of this Example show that EDIHN can be used to generate hair growth in human skin as for mouse skin.

Example 8

Molecular Pathways Activated During HF Stem Cell Activation

Materials and Experimental Methods

Isolation and Activation of HF Stem Cells

K15-eGFP mice were depliated in order to induce formation of new HF. Activated hair follicle stem cells were isolated from K15-eGFP mice using fluorescence-activated cell sorting (FACS) two days after depilation and 5 μg (micrograms) total RNA from the cell population was isolated, reverse-transcribed and hybridized to an Affymetrix (Santa Clara, Calif.) array MG_U74v2 chip. Scanned chip images were analyzed using Affymetrix Microarray Suite 5.0 and Gene-Spring software (Silicon Genetics) to detect fold-change differences between activated HF stem cells (HFSCs) and non-activated (telogen) HFSCs. Values were normalized before computing fold-changes and differences between non-activated "bs-line" and activated ("expt") samples.

Results

To identify molecular pathways up-regulated during HF stem cell activation, activated HF stem cells were isolated, and the gene expression patterns of the cells were analyzed to detect up-regulated transcripts. The transcripts depicted in Table 3 were up-regulated at least 2-fold in the activated HF stem cells relative to the cells prior to activation. In some cases, the sequence in Table 3 is a genomic sequence that contains the sequence of the transcript. Data pertaining to the up-regulation of the transcripts and further information about them is provided in FIG. 22.

TABLE 3

RNA transcripts up-regulated during HF stem cell activation.

SEQ
ID
No: Access. # Sequence

1 AW047343  uuuuuuuuuuuuuuuucuuaaaaauauaaauguauuugucugcaucaugacguucuucgggc
accuagcuggccagaccacuggccaugggacaaggaggaagucagguguaagucugagcaagga
acaggacucugcccuggcagggugga gguggccucacagugucccaugcugggccugguagcgu
gaaagcacagcacggguagugggacagcuccugccgcacagccaccaccuccugccgcaacagggc
guuuccuuccaggaaggcagcccgcacagauauccgguucuccuugagucuucuugcaucuc 2 AF053235  Sequence below.
caguccucagcauggccaccugcagccgccaguucaccuccuccagcuccaugaagggcuccuguggcaucggguggugcu
cuagccgcauguccuccauccuggcuggaggauccugccgggcucccagcaccgcgggggcaugucaguuaccuccucucg
cuuccucucgggggagucugugggauuggaggugg cuauggugggagcuucagcagcagcaguuuggguggaggacuug
guaguggauuugguggucgauuugaugauuuggguggguguuuugguggcugguccuuggguggugguccuggcggguggua
uuggugauggg cuccugguggg cagugagaaagugaccaugcagaaccucaaugaccgccuggccaccuaccuggacaaggu
gcgugcccuggaagaggccaacagagaccuggaggugaagauccgggacugguaccagaggcagcggcccacugagaucaaa
gacuacagcccc uacuucaagaccauugaggaccugaagag caagaucauuauugccacccaggagaaugcacaguucacuu
ugcagaauugacaaugccaggcuggcagcugaugacuuccagg accaagacgagaaggugcgguucuuggcggcaguccgug
agggugacaucaauggccugcgcaaggugcuagaugagcugacccuguccagagcugaccuggaaaugcagauugaaaaccu
cagagaagagcuggccuuccugaagaagaaccaugaggaggagaugcuugccuugaggggucagacugguggggacgucaa
uguggagauggacgcagcccccggguguggaccucagccgcauucugaaugagaugagggaccaguauga gcagauggcaga
gaagaaccgcagagaugu ggaggccugguccugaagaaagacuggaggcugaacaaaggaggugg ccucuaacagugaucua
auccagacaaccgcagcgagguggcugagcuccgcagggug uuccagggccuggagauugaacu gcaguccagcucagca
ugaaagcauccuugg agaacagccuagaagagaccaaaggucagauacuguaugcagcugucccagauccagggu uuugaucag
caguguggaggagcagcuggcucagcuucgcugcgagauggagcagcagagccaggaguacaacaucuuguuggaugugaa
gacaaggcuggagcaggagaaucgccaccuaccgccgucugcuggauggcgagaauauccacuccuccu cc aacagcacuccucu
ggacagucuauucuu cucg agaagu cuuccucuacucucuccccg ccagcccc ggccuccauccuca aggagcaagguuccaacca
gcuucagccagagcccaaagucagaguu ccagggacuaauguuu ugcc uagagccuccucacccacaacugccucucaagcug
agggcuggggcaggacccuguuucuugcgcauucccc caucugucucccc uacccucucauggugguaggcuaauaaag
cuuuuuggu ugaugcaaaaaaaaaaaaaaaaaa 3 M26005  gcgccaguccuccgauagacugagucgcccgggua cccuguuc ucaauaaagccucuug
cuguuugcauccgaaucgu ggu cucgcugguccuugagaggg ucuccucagauugauuga c
uacccacgucgggggucuuucauuuggaggccccagcgagauuggagaccccugcccaggg
accaccgaccccccgcu cgggauggu aagcuggccagcggucguuucguguc ugucucuguc uu
cgugcguguuuugugccggcauuuaauguuucgcgccugcgucuguacuag uuagcuaacuag
aucuguaucuggcgg uu ccg cggaa gaacug acgaguucguau cccg gccgcagccc ugg
gagacgucccagcggccucgggggcccguuuuguggcccauucuguaucaguaaccacccga
gucggacuuuuggagcuccgccacuguacgggcuuuguuggggg acgagagacagagac
acuucccgccccc gucugaauuuug cuuucgguuuuacgccgaaaccgcgccgcgcgucug
auuuccuuuguuguucuuuuguuccuucguuaguuuucuucugucuuuaagu guuuucgag
aucaugggacagaccguaacuaccccu cugag uuuaaccuugcagcacuggggagaugu cca
gcgcauug caucca accaguc uguggau gucaagaagaggccuuggauu accuucuguucc
cugaauggccaacuuucaaugugggaug gccucaggauguacuuucaau uuaaguauuau
cucucagguuaag ucuagaguguuuu gu ccuggucccca cggacacccggaucaggucccau
auaucgucaccugggaggcacuugccuaugacccccc uccgugggucaaaccguuugugucu
ccuaaacuuccuccccgccg acagcucccg caccucccg cccgguccuucu gcgcaaccuccg
ucccgaucugcccuuuacccugcccuuaccccc ucuauaaaguccaaaccuccuaagcccccag
guucucccugauagcggcggacccccaucaugaccuucucacagaggaccucccgccguacgg
agcacaaccuuccu ccucu gccagagagaacgauaaagaagaggcggccaccaccuccgaggu
uuccccccccuucucccauggu gucugcugcggggaaggagagaccucccgcagcggacu
ccaucaucuccc caggcauuccca cuccgcaugggggagauggccagcuucagu acugccg
uuuccucu cucugauuu a accccuuccuu uucugaagauccaggu aaauugacggc cuuga 4 AA681998  gacguagagcccuugcgcccgguuuccugaucccgcuuacucc ucugcgcgccggcaggau
ggcccacaagcagaucuacuacucagacaaguacuucgaugagcagcgaaguaccggcaugu
cauguuaccc agagaacucucuaaacaaguacccaaaacucaucugaugu ccgaagaggagug
gaggagacuugguguccaacagagucuag gauggguucauu acaugauucaugagccagaac
cgcauauu cuucucuuu agacgaccucuccaaaagaacaacaaaaaugaagugcagcuggga
ucaucu aaucuuuucaaauuu aauguaugu guauauaaggu aguauu cagug aauacu
ugaaaaguguacaaaccuuucauccau accugugcaug cgcuguau ucuucacagcaacaga
gcucagucaaaugcaacugcaaguagg 5 AF057156  atuaaaaagccagcugcccaaugccugcacacagaauccacaccaacagagaaccugcucuucu
cugaguauuagguaagucucugcuugcaa cugauuugaaauucu gcuuauuuuuuacua
ugaaaaacuguucaaagccaacucuauuacagaguugaugug ggguguugcuacaguuagu
gaacaguagcauuguuugcuuaaauuauagcacauuuuggg ucuaggaacuugagaggu ga
uucaguuggucacuguaguaugacagccuuggaaucagagauuaaggcaaaaggaaaccucca
uucaaauauuccaugg aaguucacagcuggagacagguuaaggcuucaguccagauagcuuuc
agaauuauugcaguucuuacugauaggcauaucaauagcgaaauuuaauuu auuagaggaau
cuacuaaaguaaauuuuagg ccaauauagaacauaccauacuuguagucuggcagagaagg
ugacauaugaaaauguaaaugcauucaacagugugaguguaagaaaauaauuggggggan
gggcugugcangggaggcaugcucaaggacagcacuuaguggu agcacacaccaugaacua
uguggaaaagcauuuauaggcagaacagaaauguaggaaaug uagggauccaugaga
gcauaaacuaaagggcaaaagcauaug agcauggacuaacaugcag ccacucugcaaguuau
acuaugaucuauuu cacaaggagguuuggu augcugcugu cuuugggug acaccgcuuuccc
agaugucc ugguguguaggu ucacaagccucucagaagccauacuuuauugcuuuuuaaga TABLE 3-continued RNA transcripts up-regulated during HF stem cell activation.

| SEQ ID No: | Access. # | Sequence |
|---|---|---|
| | | cguauuauuaauauuuuggcuagcauauggguuuagugugagaguuuuauaugcauauguca uuauacuuugcucauuuaugucuuggaacuucuucaacuagguagaaaacaugaccagggag aaugagaguaaggaaagaacccacugagacagacaagagcaaaccauacuuucugcuaaucaug uuuaaaaguccagaaaugaucauaccauauuuuauuuucaagugguggaagucagcauggaga gggggcucuuuuucucuaaagggggccugaaauuaaauugacuugaugugaggguuaccuucu cuuucaaugaaucacuaaauugucuuuucuguuuucccaggacccaagugcuaucuaaccaug aguucccaccagcagaagcagccucugcacuguaccucccucagcugcugcaccagcagcaggugaag cagccuugccagccaccaccccaggaaccuugugccccaaaaccaaggaucccugccacccu guccugagcccugcaaccccaaggggcagagcccugccaccccaaggcacccgagcccugc caccccaaggcaccugagcccugcaaccccaaggugccagagcccugccagccuaaggugcca gagcccugccagccuaaggugccagagcccugcaaccccaaggugccagagcccugccaaccu aaggcaccagagccuugccacccaaggcgccugagcccugccacccuguuguccccgagccc ugcccucaacugucacuccaucaccauaccagcagaagacaaagcagaaguaauauugucca gagccaugccgaagaccugaucaccagaugcugaggcugcugucuauccugcuuaugaguc ccauugccuugugcuaccaaugcugugaccuucagucuuaaauccccucucuccuugcaccacc uaaaaaguugacucucauccucaucuucaagggcuccugagcccucuuaacauugcccaaagu cauauugaauggcuacacuuuucauggcucaggauucaucugaaggggggugaggagugaga caaguguauggucaauauuuuccccccauuaaaugccauuuaacucc |
| 6 | AI845584 | uuuuuuuuuuuuuuuuagccaaaauaguuauuuauuaauaauuuaagguuuuacauuucu uauaauaaauuccagcucaaaacuuuacaccacgaacaucauggagcaaguuaauucucccuu ccucucaaccuguugcauccaccaaauggggcgcucauacucgcacacauacacacacuuccag uuucguauuuuuuuuaaaaggaaagaaaccaacccaaaguauugcauuugaggugacacuc ccugaa |
| 7 | AA614971 | aagaugcccuuuggauuggauuggauugaucauguuuaacucagcguauuuuauggaugaa agcuaaauacagauauuuggcaucucuaaggugggaaugagcccacuccacacacugauaaaau ucaugcauaguuu |
| 8 | AV374591 | aaccaaauggggaauggggucccaacnuncuguggguaccagcggguuucucuugcauug gaaacaaacaccuuuguaggcauuugcguauucgugaagagacuguuuuaugaaucaccucu uagauuuaauaauuaaccuaaguuguugaaaguuucuguuucccuuaagagaaaauuacaa aaauucaacauugaagcauaguuucuuguuuucuguugucaaauaguaauaaugugcugug augucaaugcuuauucauaaagaugguuuuacuuuuuaguguaaugauaguucuuuuuaaca uuauuuugcuuaaauuugauaaugcccgacaagaauauauuuugcuuugauuuauacacug auucuuugugacaaauaugacccauuaaaaaugccuuuuaauagacuaaacuuaccuuuugua gcuagguacucaugucuuuuuuaaaagaugcccuuuggauuggauuggauugaucauguu uaacucagcguauuuuauggaugaaagcuaaauacagauauuuggcaucucuaaggugggaau gagcccacuccacacacugauaaaauucaugcauaguuuuaaaugaacauuaauaaacucaug uugucuu |
| 9 | U04443 | gaauucaaggaggcuuuccagcuguuugaccgaacaggugauggcaagauccuguacagcca gugugggggaugugaugcgggcccugggccagaacccuaccaacgccgaggugcucaagguuc uaggaaccccaagagugaugagaugaaugugaaggguacuggacuuugagcacuuccugcc augcugcagaccguggcgaagaacaaggcccagggaaccuacgaggauuaugaaggccu ucgugucguuugacaaggaaggaaaauggcaccgucauggugcugaaauccgucaugccua gucacacugggcgagaagaugacagaggaagaaguagagaugcuaguggcagggcaugagga cagcaauggguugcaucaacuaugaagcauuuugaggcauuucugucggggugacgggccc gauggggcggagcucguccggaugguggugaaggcugagacauucuguauccgagucug uucccugcccagugugauuucuguguggcuccagacgcuccccugucacagcaccuugcccc auuugguuucuuuggaugauguuugccuucaccaaauaaaauuugcucucuuugccc |
| 10 | Y07836 | caaccaccuccuaccugccugcccaaagcuccagggcuggagcacggagaccugucaggg auggauuuugcccacauguaccaagcguacaaguccaggcggggaauaaaacggagcgaa gacagcaaggaaacuuacaaacugccgcaccggcugauugagaaaaagagacgugaccgg auuaacgagugcauugcccagcugaaggaucuccuacccgaacaucucaaacuuacuacu uugggucacuuggaaaaagcaguggguucuggagcuuacguugaagcacgugaaagcauuga caaaucuaauugaucagcagcagcagaaaaucauugcccugcagagcgguuuacaagcuggu gauuugucgggaagaaaucucgaggcagggcaagaaaugucugcucaggguuccagacuu gugcccgugagguacuucaguaccuggcgaagcaugagaacacucgggaccugaaaaucuucc cagcucugcacucaucucaucgugugggcuucaggcagggcugcuccagggguggugcuuccagga aaccauuggacucggcucccaaagccgucgacuugaaagagaagcccagcuuccuagccaagg gaucagaaggcccagggaaaaacugugugccagucauccagcggacuuuugcuccccucgggu ggggagcagagcggcagugacacggacacagacaguggcuauggagguugaauuggagaaagg ggacuugcgcagugaacagccguacuucaaaagcgaccauggacgcaggguucgccguggggag aacugucagcacaauuaagcaagaauccgaagagcccccaccacaaagagccgaaugcagc ucucagaagaggaaggccacuucgcgggcagugaucugauggguucccauuucuugggcca cacccacaucagccuccuuuuugccuucccuucuaucucauucccaccaucggccacugccuac cugccuaugcuggagaaaugcugguaccccaccucgugccagugguuauauaccaggccucaa caccucagcugcagccccuccagcuucaugaacccagacaagauaccgacuccccuugcuuucu gccccagagacucccuucuccuuuggcacauucgucccuugacucuucggccuugcccagg cuuugaagcagaucccuccuuuuaaacuuagaaaccaaagacuaaacucggagggaucuccu gcugccuugcuuucuuuccucccuaauuccaaaaaccacgaagguuucccugagugcagaga gaucagcccaccccugcagacccacagagaagauucagagugugugugagagugagugagugu |

TABLE 3-continued

RNA transcripts up-regulated during HF stem cell activation.

| SEQ ID No: | Access. # | Sequence |
|---|---|---|
| | | gcgugcgugcgugcuuguauguauguuuguauauguaggacaauaaguuccuucugacaca agggagacacgagaaggauagccugacaucagaugacagacuggaggacuguagcacaucuc ugggcguuuccuacccagagaagagcc |
| 11 | M21285 | Sequence below. | uugcaggcgagggcuuccacaacuaccaccacaccuuccccuucgacuacucugccagugaguaccgcuggcacaucaacuuc
accacguucuucaucgacugcauggcugccCugggccuggcuuacgaccggaagaaaguuucuaaggcuacugucuuagcca
ggauuaagagaacuggagacgggagucacaagaguagcugagcuuugggcuucgaguuccuguuucaaacguuuucuggc
agagauuuaauauucuguugauuaacuaacaacuggauauugcuaucggggUguuaaugaugcauuuaaccuauuccggua
caguauucuuauaaaaugagaaagcuuugaucacguuuugagguaauaaauauuuuauuuagcuaggauuaaccaugccac
aagacauuauauauuuccuaagcacacaugauaaaugcauauacaauuuugcacaacgacuuuaauaauaaacaauaaauuug
aacauucuauacagagaggaucaaagccaaggaacaugcuguuuugaugcuagggugagcauggugcucagucccuguuug
uuugcauggugUccagcuuuguuucucucugucaucaccaccuucaggcaaauaguugaccaaccacuggccugugucug
uccaccucccaaagcccaggccaccuuucuguuuucugaaauacugauccuuccuccugaauacaucccuccuuguuccuag
cuucaagacugcugccucaaauaggGauagacaaguccccgcugcagguugcCuagguuggauggagaaauuaucuuca
uuugauacagagcaaguagauugucucgagagaaaaguuagcaugcguggGauGauuuguaaguaaagauggaagagagag
agagagagagagagagagagagagaGagagagaGaggGuagccauaucuaacagccuacuaccaaagaccccaggccucuc
ugcuuggcaugccuccuuucuguccauccucugaaccccagagauuagugagauuugaauaauuaaaucauuuucagagug
aaggggguuaaugcagggucugugcuaggggaggguuuugguaacugaagauuuuuucauggaaaaagucuuc
guguucaaugugccuagaacugauaacuaaacagcugacauuuugucgggacagaauaggugugaaacuaugaaaauauaa
gcaaaaucuucacuuggaacaugaaacuauuucacuuagaaaauaaucgaaggaccCgagguguugccugggUugccaguuu
cuuucguggcugggcaggaacuagugagguugaggggcagugucuguaaguagcugcuaagaggugcauuuccagaugaa
gccuugggGaacaucugccagggaucCgcauggUguuggcuccauccauugcuuuaguuuccuccuuggauugugagaa
acuuggcuucccauggUuuugaaccuuccaugccuucuuugcuuugUggccaccCagccugccuagugcugccuaggaagc
ucuuacccaccugauuucuucugacauuucuuucuuuggccuuuuucuuucuccggacaugcagcuaguugccugagu
guaucaagagcacccaggacuugcugcugucCaggccuguuccucccCagauccgggGugUggaagagcugugUagcu
ucaggaagcagagccaggugccaccuuucuguggcuuccagauccuccCuaccuccaacucaugugccucugucacagugau
uucaggaaagcuuggUagacccucuagcaacaucucgguucagaugguuuacuuuuucuaggugagGuuaacagcucaguau
ugcuguuugucucagugaguuaaccacugaaugcgagggUugguuguugaucugucucggugUGugucggagUagacag
cauaugcacuucuccugugcgcuuugcaagguaaugugGcuuuggcugauccaugcagGcagGuaguggUacaGuGcugc
ugaaaggaagaaguucccCauuuuaucuguuaaaacaccagagacauggGcaagugcuaauggaccucacuucaggaagagg
gucugcuuccugaaGccagugugugaugauaaaaGgUGacuGgaccuGuauauCgagaccuGauAccuaacaCucuGu
cacacagUCcaggGccaacagUgcuauaggaaagucuagaagaaaacaucaucagUauuuugaaccaucaaccaucucuu
gucccuauagcccaauccagaggccuggUuuuUagaaCuGGcuguGuaaggUGcCaaacacucaguucacuuguaGaaucag
agccuuuuuccccccuauguuaauugaacacgCGcucgaGcugUuuUguuGaaguaGaaaaucucauaGaaaaaucacu
guagaucuacugaccuuauagccccucuggaaaagccuuGgGuuuacuuuuucuaGGucauagaagccugauuuauaaa
gaugaacaauaauucagcuuucuuuCUcucuucugaucuuauucCCagaucugauucaggccauguuccaaagcaagg
cuacauugagguccugGUgucuuuaagUaaggacaucuuucagauccucucaaagaaggauuuauaacaguuuccagaug
aauguacuaauagcuuugggugccuuaucucuuuccuaaUcuGuagugccugugagcucagucucaCucCuucccuuAgcc
cgGagaccccuuagaucgaGuggGaaugaucaaGaggGcuggGagagcucaucaGuaCauuggUuugcagaaaucuuuuua
caggcuacauuuuggaauuuuUuUUuUuuuaGuaaguGaucaaauuugGuggaaguaauuCgagugUauuCgauuGuau
ugucguccUcgUuAucAUuGucaaacaUguuAuaGaCggcaguuggcacuggGGcuGcuaaucucugggUguaGucucuga
aacuguagcuccagugagguggugugaaagguuagcaaagccaccaucgcuggUgucccagccaagGUgccucuuagccac
ugaauGgcuaaGuuaUCcuuUCuCuuuGuaacaaaccccaCccaagAGaGaaAaaGaaaCCCaagaaAAcuccuGggCu
aaguaucgacagucucacaucucaacagugugaauuaaguguccauagcaucagcucaggaggacacucugggagagugcu
gacaaaaagGGUuauuaauacugaccuacuacuucaagGGcaguucgaggugauuagagcuuuUUuuaaaaaccaaguau
uggggGauccucagcagaggGuauucauacagacucccaaagaacuauauauguuccugagaccaucguuuagucuacauugc
ucuuccCagAgAcuGacagaauGaccagucaaagUgcaagaCuaccuaccaCUgccaugaaaaCCauugcaggaaaccuuuu
cccuuccuGaauGagauuuuuuuuucccuuuuuaugugggguaauuauuuugugaccCaaguguaauuuggaugauuucc
auuaaauaucaacucuugaagcCuacuugacuGauuugagauuauuuguccuaauaaaaguGgaucuggUuGuacuguc

| 12 | V00756 | accacuugcagacaaaugaauuccuucgaaauguauuuugagguuggaccccugugaugcuu |
| | | gaugcugcaacacuuaaaaccaugaagauuucucguuuugaaaggcauuuauaauaacucugc |
| | | agcuuucaaagcucgaacaaaagcucgaagcaaaugccgagauaagagagcagauguuggaga |
| | | auucuguagaugucugaauuugauggcuguuuucuaaucucuuccuuuauuauuauuuu |
| | | ugcuacuucuaaugauauaagcuuuuagagacaguuuuuaucuugggucaacuuaaauaa |
| | | uuuuugauguaggggugguguauuuuaauuuaaguacaguguuacaaauuaaugagu |
| | | ucuuuauucucuguaaaaauaacuggauaccacaaauaagugUuugugauguuuggucgu |

| 13 | Y14296 | augUccgcggccgccuacauggacuucgUggcugcccagugUcuggUuccaucuccaaccg |
| | | cgccgcgugccggagcacgggggcgcuccggaagcggcugcgacuaccugagcgcg |
| | | aggugaccaaggaacacgugaccCgggggacaccuggaaggauuauugcacgcuggucacu |
| | | aucgccaagagcuuguugaccucaacaaauaccgacccauccagacccccucggugugcagc |
| | | gacagucuggagagucccgaugaggauauaggauccgacagcgacgugaccaccgaaucugg |
| | | gucgagucuuccacagcccggaggagacacagaauucuggcagcgcgcccgcccacucuc |
| | | ccuccuccacucuggagugGcuucgaagggGaaacacgccucccgaaaagaggcacaagcccc |
| | | cuacaguggcuguggGaaagucuauggaaaaucuccCcaucuuaaagcCCauuacagAgugc |
| | | auacaggugaacgccuuuccCugcacguggCcagacugccuuaaaaaguucucgcgcucg |
| | | gaugagcugacccgccacuccggaccCcacacugGGgaaaacgcaagcacguGccCacguG |
| | | ugagaaGagauucaugaGGaguGaccaucucaccaaGcaugcccGGcgucacaccGuGuucc |
| | | auCccaGcauGaucaaGaGaucAaaaaGGCucuugccugccCcuuGUGaGGuGcuccCCau |
| | | ggcagccaggcagagauggGuccccggaaggacagagcucccaggaaacagacugacacaugg |
| | | aaaucugccacagcagaggcgcgcuggccacaggaggucacugcuucuuuggccaauauucu |
| | | gauaucucccugcacuguuuccaaaaagcacaugguagcccuaaggucaaagucaacauuug |

TABLE 3-continued

RNA transcripts up-regulated during HF stem cell activation.

SEQ
ID
No: Access. # Sequence

```
          gucccuugcagaggcaacucugaaccgucucugacugaagauucagacuggugugua cau
          acgucunacugggugaguugaccccuggccuccacagugcagaaccacucucuugaaucac
          auuaacuuuugagauuuaaaaaaaacccaaaccaaccnncaaaaacnccaganacaccgaaac
          ucuggauccucgaugcuugcugacucucagaauugnuunuucuucanuuaugcaagcna
          gagcacaccuacuccagcaugauuugucaucuaaagacuugaaaacaaaacaacaacaacana
          aaguuacuuauagucaauggauaagcagagaguccgaauuuacacuaaucaagacagaccuucg
          aggggucacgauaagccggaacuuucaaaccuugcucguaugaauguacuaucugaaca
          uaaacugcacuuuuauuuucuaauaccgaggugaauacggu aaauacaugcuuugagggu
          agaanccgacggucuguuggcaccacguuauaaucugcunnuuuuaacgaguaccaccuug
          gagggcaggcaaauaaaugcuuuugggua uuuucuccuuuguuuuuga caaaugcugcgga
          ugggggaucgggaucggagggga gugcuuuuaagauaauaaaaaaugagguaaauaauuu
          uaacuuaugaauuuguuugaauuc
```

14 X16490
```
          gagauugaaacaauggaagaacuuuccauggcaaacaccauguuugcccucaaucuccuu
          aagcagauagaaaaaucaaacucuaccca gaacaucuuuaacucucca uggagcaucuca
          ucaacauuggccauaguucuccucggugcuggggguaacacugaacagcagauggccaaa
          gugcugcaguuuaaugaaauuggcaguuaugguaucaccacaagaaacccagagaacuuc
          aguggcugugauucgcacaacaga uacagaaggaaaauuauccuagugcuauuuuacaggc
          acaagcaggagauaaaauccauucagccuucuccucucucagcucaa caaucaacaca
          ccacaggggga uuauuuguua gaaagugcaaacaagcuguuuggagagaagucugcaagauu
          caaagaagaauacauccaacucucuaagaaauauua cucaacagaaccagaagcagug
          gacuuccuugaaugugcugaagaagcuagggaaaagauuaauucuugggucaagacucaaac
          caaaggugaaaucccaaaccugcuacccgaagguucuguaguga agacaccaagauggugc
          uggugaaugcugucuacuucaaaggaaa guggaaaacuccauuguga gaagaaacuuaaugg
          cuuuaccuuccgugugaacucgcaugagagcauaccuguccagauga uguccuccaugc
          aaagcugaacauuggauacauaaaggaccugaagacucagauccuagaacuuccgcauacugg
          aaacaucagcaugcuccuguugcuucccgaugagauugaggacgcauccacuggcuuggaau
          ugcuggaaagugaaauaaaacuuugccaacucaacaaguggacagcaaagacacacuggau
          gaagaugauguuguggucuacauucccaaguucaaacuggcacaaagcuacgaacucaaguc
          cauucuucaaagcaugggcauggaggaugccuucaacaagggcaaggccaacuucucaggaa
          ugucugagaggaaugaccuuuucuuucugaggugua uccaucaagccagcguggaugucac
          cgaggagggcacguggcagcuggugggacugggccaguua acaggaagaacuggccau
          gguggcccacaguuuguggccgaucaucccuuucuuucuuuaucauggacaaaaauuaccca
          cacgauacuauuuguuggua gauucuccucacccuaaaaggggaagaccua uuuccacauga
          gguuuuguagcaugaacuauaagccucagaauugcaucuucaagugccaaaaguuuaaauac
          uuucuuacacauuuuuauacuucugcuauaacacuaaaauauaaccuaaaagcaauuguaaugc
          agucuucagugcuuacaguauaacucuauuaaugauuuuuguuccuaaaagucagaugaugu
          cuauuuaguucauccuuauuacugcuuugucuuuauaacuuuaguuuuuacaguguuauu
          uauuguuuauauaauggu uguuuuacaaauuguugcccucuguuuaaugaaacuguaacac
          uacagaagcagaaaauuaga uaauuucuauuuaaagaaaaucagccauuuaauuuaauuaau
          gaaggaaaaauaugagucuuccauacauuucccaugauauucacccagaaaaaaaugua cuuaac
          aaaagacauguuuauaucucuaucauuauauaucauauugcguaucugcaacucaucuauaa
          uuaggacuacaucauaaguaagcaugcuuacuuacacacugcuaucguuguauaaaacuua
          gcaauccuuauuuguuaguuaucuuucua ucacuguaacaaaauaccugagauaauaaaguu
          caaagauuuauuuugaaaaaaaaaaa
```

15 AW120868
```
          uuuuuuuuuuuuuuunuaagaauuaaacuuuuauuuuugcuuaguuuuauuaaaaaaauaa
          auaugucauaaagcuuuuguuuucuuuagggagaaaaaaaaggaacaaguuccauaaaauca
          aacaagcaauguaacaugucuuaacuugaaaacaacugggg ucacugguuuacaaguuaua
          acugaaugaaugacugccacaguugcccauuccuccugccaauggcagcaaacaacaggauc
          aacuagggcaaaauaaauaauugugugg aagcccuga
```

16 C78850
```
          aacuaaacuuccuuguaacuuuugagaacucagcucuggua cuuuuucaugccuugcaaaau
          ggcguuanugcagcuagcuugcuaaccuuauggugggg ucuuucauuccccccucuuucu
          ggaaacugauaaaaucauuuauucacgugauucuauuucuucuggaucuauugauuugag
          uuggugauacuguugggucanaaccagggccuguu
```

17 D67076    Sequence below.
```
gcagcuccgagcuaggugcuaucgcaaggccagagcgcacagcccggcggagagagcagauccuugcucagaucgagucaaa
ucgggccaaggcggaggacgaagaguccaggcuccuauucggacuuguucccagcuccgggggcgcuucuagguccgc
agcagccagcagugcggagccaccaacucggcuggaaugaaaaaauccgccagugcagauucuuucuaagugac
ccggagcuucgggugcuagcucugcacgaacuuucccaucaaagugaucgugaauuuuaagcaucaggagcaggccagcgaa
gcucuacgcgucuaaacgucuauccagaccaagagauucucgcggugcagggugcggugccaugcagccaaaagucccuuuu
ggggucacgcaagcagaagcccugcuccgacaugggggacguccagcgggcagcgagaucucggggcucucuguccgcacac
augcuguugcugcuccucgcuuccauaacaauugcuauggcgcgucuauugggcgcccccacggaggaagauga gg
agcugguccugcccucgcuggagcgcgccccgggccacgauuccaccaccacacgccuucgucuggacgccuuuggccagca
gcuacaucugaaguugcagccggacagcguuucuuggcgccuggcuucacccugcagacugugggcgcaguccc gguc
cgaggcacaacaucuggaccccaccggggaccuggcucacugcuucuacucuggcacggugaacggugauccc ggcucugcc
ccgucugagcucugu gaaggcugug gugcccgaggagagcaucaucaagaggcgccaguuccacauucagccagcgccugga
guggccaccgagcgccuggccccugccgugcccgagga ggagucaucaaggagaggguucaguucca cauccugaggcgaaggc
ggcggggcaguggcggcgcaagugccggcguca uggacgacgagacccugccaaccagcgacucgcgacccgagagcc agaa
cacccggaaccagugggccugugcgggacccca cgccucaggacgcgggaaa gccaucaggaccaggaagcauaa ggaagaagc
gauuugugucca gcccccguuauguggaaaccaugcucguagcuga ccaguccaugg ccgacuuccacgcagcggucuaaa
gcauuaccuucuaaacccuguucucgguggcagccagguuuuacaagcauccca gcauuaggaauucaauuagccuggugu
```

TABLE 3-continued

RNA transcripts up-regulated during HF stem cell activation.

SEQ
ID
No:Access. # Sequence ggugaagaucuugguacauauacgaggagcagaagggaccagaaguuaccuccaaugcagcucucacccuucggaauuucugc
agcuggcagaaacaacacaacagccccagugaccgggaucacagagcacuaugacacugcaaaucuguucaccagacaggauuu
augugcucccacacgugugacacucucggaauggcagaugauguuggaaccguaugugaccccagcaggagcugcucagucaua
gaagaugauggauuugcaagccgccuucaccacagcccaugaauugggccaugguguuuaacaugccgcacgaugaugcuaagc
acugugccagcuugaauggugugaguggcgauucucaucugauggccucgaugcucuccagcuuagaccauagcagcccu
ggucaccuugcagugccuacaugguacguccuuccuagauaauggacacggggaauguuugauggacaagcccagaaucc
aaucagcuccccuucugaucuucccgguaccuuguaugaugccaaccgccaugugucaguuuacauucggagaggaauccaag
cacugcccugaugcagccagcacauguacuacccugguggugacuggcaccuccgguggcuuacuggugugccaaacaaaac
acuucccuuggcagaugcaccagcugguggagaaggaaguggugugucaguggcaagugcgugaacaagacagcuga
agcauuugcuacuccuguucauggaagcuggggacaugggaccguggggagacugucaagaaccuguggugugaag
uucaauacacaaugaugaauugacaauccagccuccaaagaaccggaaggaagcuuuagcucacucaaaagaaguacaggg
uccuguaacaucgaggacuguccagacaauaaacggaaaaaacguucagagaggagcgagugcgaggcgcacaaugaguuuucca
aagcuccuuugggaaugagcccacugauagaguggacacccaaguacgccggcgucucgccaaggacaggugcaagcucac
cugugaagccaaaggcauuggcuacuuuucgucuuacagcccaagguuguagauggcacucccuguuagucugcagacucuacc
ucugucgugugcaagggcagugugugugaaagcuggcugugaacgcaucauuagaccucaaaaagaaguccaaaagaagugugc
guuguggaggaaacgguuccacaugcaagaagaugucaggaauagucacuagacaaagcacgggguacaugacauuguca
caaauuccugcuggagccaccaacauugaagugaaacauccggaaucaaaggggguccagaaacaauggcagcuuucuggcuau
uagagccgcugaugguacuauauucugaauggaaacuucacucuguccacacuagagcaagaccucaccuacaaggguacu
gucuuaaggucaguggguucucuggcugcgcuggaaggaauccgcaguuugguccacucaaaagaaccccuuaaccauccagg
uucuuaauggccaugcucuccgaccaaaaauuaaauucaccuacuuuaugaagaagaagacagagucauucaacgccau
ucccacauuucugaguggugauugaagaguggggggaguccaagacaugcggcucagguuggcagagaagaguagu
gcagugcagagacauuaacggacaccccugcuuccgaaugugcaaaggaagugaagccagccaguaccagaccuugugcagac
cuuccuugcccacacuggcagguggggauugucaccauguccaaaacuugcgggaagggguuacaaagaagagaaccuuga
aauguguguccacgauggggggcguguuaucaaaugagagcugugauccuuugaagagcaaagcauuacauugacuuuu
gcacacugacacagugcaguuaagaggcguuagaggacaagguagcguggggagggcugauacacugaugcaagaguac
uggaggaugccagugagucaaaccaguaagcaguaggguguggcaaggaggugugaggggauacauagcaaaggaggu
agaucaggacacuacccugccaguuacauucguauaaggguaguuauagaggcacaguagcaucugaaagaccauacagagca
cuaaggagccccaaagcacuauuaguaaucucuuuucuuuaaaaucuaucgcccaaauaaauuucagagucuggcagaagcccug
uugcacuguacuaacuagauacuucuauucacaaagauugggaaaggcaaagcagaaagauggaagacuggguuucaaaca
aggcuugguuucaaucacuggaggcaaggaggagggacaaacaagaucauuauucgaagucgcugguugcuguggguuua
cggaagguugaugcaucauuccuaucaacagugaaaguucagcuuguucaacgugacagaaaggcucauuccccgugaaaga
gcuccugauuucuucuuuacaccaucuucagucuucuaaaacuauaguucaugauugaccagagucuggcagagaacuuga
guacauuggaaaaaaaagugaaguuuaugaggugaugaggugacacauaaaaacugaaggaaacaauggcagcuuucuggcuau
uuccuccugagguaaaccugccuggggauugagguuguuuaagauuauccauggcucacaagaggcagaaaauaauacau
guuguuggccagaguuagaaauggggauauagaaaucagggucccaugagauggggaacauggugaucacucaucucacauggga
ggcugcugcag 18 M61007   ccgcgggcccgcguucaugcaccgccugcuggccugggacgcagcaugccuccgccgcc
            gcccgccgcccuuuagacccauggaaguggccaacuucuacuacgagcccgacugccuggc
            cuacggggccaaggcgggcgcgccgcgccgcgcgccccgccgccgagccggccauugg
            cgagcacgagcgcgccaucgacuucagcccccuaccuggagcgcucgcgcccgccgga
            cuucgccgcgccccgcgccgcgcaccacgacuuccucuccgaccucuucgccgacgacua
            cggcgccaagccgagcaagaagccggccgacuacgguuacgugagccucggccgcgcggg
            cgccaaggccgcgccgcccgccugcuuuccgccgccgccucccgccgcgcuaaggcgga
            gccgggcuucgaacccgcggacugcaagcgcgcggacgacgcgcccgccauggcggccgg
            uuucccguucgcccugccgcgcuaccuggcuaccaggcgaccgccgagcggcagcagcgg
            cagccuguccacgucgucgucguccagcccgccggcacgccgagccccgccgacgccaa
            ggccgcgcccgccgccugcuucgcggggccgccggccgcgcccgccaaggccaaggccaa
            gaagacgguggacaagcugagcgacgaguacaagaugcggcgcgagcgcaacaacaucgc
            ggugcgcaagagccgcgacaaggccaagaugcgcaaccuggagacgcagcacaaggugcu
            ggagcugacggccgagaacgagcggcugcagaagaagguucagcacugucgcgagagcu
            cagcacccugcggaacuuguucaagcagcugcccgagccgcucuggccucgcgggcca
            cugcuagcgcggcgcgguggcgugggggcgccgcggccaccgugcgcccugccccgcgc
            gcuccggccccgcgcgcgcgcccggaccaccgugcgugcccugcgcgcaccugcaccugc
            accgaggggacaccgcggggcacaccgcgggcacgcgcggcgcacgcaccugcacagcgca
            ccggguuucgggacuugaugcaauccggaucaaacgugggcugagcgcgugugggacaggg
            acuacgcaacacacguguaacugucuagccgggcccugaguaaucaccuuaaagaugauuc
            cugcggguuguugaugguuuugguuugugguuuuuguuuuguuuguuuuuu
            uuuuggucuuauuuuuuuuuguuauauauaaaaaguucuauuucaugagaaaagagg
            cguauguauauuugagaaccuuuuccguuucgagcauuaaagugaagacauuuaauaa
            acuuuuuggagaaugguuaaaagccaaaaaaaaaa 19 C85523   aaaauguagaaggcaagauuuaauaaggcagcaacaugaaagcacacagaccagagcucu
            gggggucgaaauaaagcagcaacauggaagcacacagagcucuggggucgaaacucauaca
            ccuuagcacagggguagaggagucucgacgguicanccagaauuuuucacaggcuuauauag
            uaaaacucaaaggggggagaacuggcagggaaaguacaaguuuacaucacuaggagauuc
            ugccaaaggacaanggguucunucagaggaaaucuacguaacuaaggngucauguccuauc
            aaggnaucuacguaacuaaggagucauguccuaucauuuggcaaugauacccgnucuuuu
            gaggguuguccggagggncuuauucaaaaugulluucagauuggaaggggugggulunc
            cgguaaaaaguucuguuuucaaagaggcnguaauuuucuauucuucauucccccauucccc
            uguaaguauucnnaucuuagaauuucagaaguccauauucncuaugugggggaauaacugg
            cuuuaacccnaucuuuaaaaaugggggg TABLE 3-continued RNA transcripts up-regulated during HF stem cell activation.

SEQ
ID
No: Access. # Sequence

20 AW122030  uuuuuuuuuuuuuuuuaugaaacaguuuuguucagcccaugacuuugugcaugacuguc
guccguucuagucaccugugcucuccaucuacugccuuuuaaagcugcgucaugagaagg
aucuacacguuccaccaugacucucguuucuugccacaagagaagaaauggnuugauucu
uugcuuuucgguuaggccguuaaacaaaacucagucacaccccugccuuccacccucaaa
cugugaucacguggcuguucuuguaguuaaccagggcaacacuauauauuccaggucua
uacauugcugaggucuuuuucgguuguucauguaucaguguuuucaaccucgugccg 21 U57524   Sequence below.
gcggccgcggcuccagaccccggccuugcgcacccuccccccaccuccagcccgcgccucccccccccccacgcauggcucacc
accccucggguuucccugucaucccucaggunccugcacuuggcaaucaccacgaagagaagccgcugaccaugaaguca
uggucaggugaagggagaccuggccuuccucaacuuccagaacaaccugcagcaggugcgcugcuugcuugccccgcggu
gccccucuuugacccccuuggguggagucagauguagcacggucgccccaaagcguuucuaaauuaauagucacuuaguucu
uaucugccuuggcuuuuugcauucaaaucagccaacgucuuagaaccagaagaaaaauccccuuggurruuagugaggucuu
uaugacccaccuagggcuccugunugccugaucuccuaagagacaaaaugggaggacagauuccaagcggggaggugucu
gggguucaggaaaacucaagacuaugggguuugcuccauggcuuuuauccuuucuguuuccucucuuccauuugaugacuccacuc
cacuggcugugaucaccaaccagcaggaauugcugaggcacuucugaaagcuggcugugauccugagcuccgagacuuuc
gaggaaauaccccucuacaucuugccugugagcagggcugccuggccaguguagcagucuugacgcagaccugcacacccca
gcaucuccacucgccugcaggccaccaacuacaaugguagguucugccaguccaucaagggaugcagagggagggagaga
ugggggccacuugagucuuuaaacucccgaacguauacaaaguucagacacgugaucuuuuuaaaaagUuuuucccucgaugcc
uauaugauauucacucagaacccagauuugaguucuucaaaacugaugauguuuggguguccucaagacaauagacau
gaguugugugaggauugaaaacacguauacaguuuugucuucccuccagccacacgugucgcaccuagccucacu
cacggcuaccuggccaucguggagcacuugugugacuuugggugcugauguuaacgcucaggugaguacacucccuuccac
cuaaucucuguugggcuggcucugauggugagcaggguuucaggucagcgcuaaacuaacgccugauugcuuuuggu uuc
aggagcccugcaauggccggacagccuccaccuugcgguggaccugcagaauccugaccugguuucgcucuuguugaaaug
uggggcugaugucaacagggunaaccuaccaaggcuacucccccuaccagcuuaccuggggccgcccaaguacccggauacag
cagcagcuggccagcugacccuggaaaaucuccagaugcuacccgagagcgaggaugaggagagcuaugacacggagucag
aauucacagaggaugaggugagguguuccucccucagccgcgucaggcguucuaugggauucagagggauuu
caguugunuaacuucucagacucggcuugcaaagcaggaucccaagaauuugucucugggunguguuaagagcuuacccu
uugguugaggaaugagggaauucuagaaauugaacccaggccuuagcacauggugauaagcacacguucaaccauuaagcuc
caccccucaauagcuuagacuuuuuuuuuuuuuaaggaaagaauagguaagggaaacuccuacagccugguugcccuuguu
cuauuugguuuaaggagaaaaaagagcccaagaaaugaagguuuaaucaagcgcugucucccccuuaucccaaugucuuugguga
aguucuaggaauuuaauaugucuuuuuucccucucuuguuuuagcugcccuaugaugacuugugununggaggccagcgu
cugacauuauaagunggaaaguggcaaaaaagaaaugnggacuuguauauuguacaaaugagunuuauuuucuaaaaaaa
aaaaaaaaaaaaaaaaaaaaaaaauauacuuagcaccacaccacacagcgccuagacccaggcauuuuacuggggugau
ucggcuguugucuuugugaaauccgggg 22 U05809   cucucggucacugccggucgcuuccugagccgcugcuggcucugugucucuguccucagc
guucucuuccucguccucguccuaccacgccauggaagguuaccauaagccagaucagca
gaagcuccaggccugaaggacacagccaaucgccugcgcaucagcuccauccaggccac
caccgcggcaggcucaggccaccccacaucaugcugcagcgcugccgagaucauggcug
ccuguuuuuuccauaccaugcgcuacaaggcccuggauccccgaaacccucacaaugaucg
cuuugugcucucuaagggccaugcagcucccauuuuauaugcagucugggcugaagcugg
cuuccugcccgaggccgagcugcugaaccugaggaagaucagcucugacuuggacgggca
uccugucccgaaacaagccuucaccgaugnggccacuggcucccuggyccagggccuggg
agcugcuugcgggaugcauacacaggcaaaaucuuugacaaagccagcuaccgaguacua
uugcaugcuggggagacggggaggucuccgagggcuccgucuggyaggccauggccuuugc
uggaauuuacaagcuggacaaccucguugccauuuuugacaucaaccgccugggccagag
cgacccagccccgcugcagcaccaggugacaucuaccagaagcgcugugaggccuuugg
cuggcacaccaucaucguggacggacacagcguggaggagcugugcaaggccuuuggguca
ggccaagcaccaaccaacagccaucaucgccaagaccuucaagggccgagggaucacagg
gauugaagacaaggaggcguggcacgggaagcccccucccccaaaaacauggccgagcagau
uauccaggagauuuacagccagguucagagcaaaaagaagaucucuggccacgcccccuca
ggaggaugcccauccguggacauugcuaacauccgaaugcucacgccacccagcuacaa
agungggggacaagauagccacccggaaggccuauggacuggccucugcuaagcugggcca
cgccagugaccguaucauuuccccggauggagacaccaagauuccaccuucucggagcu
cuucaaaaaggagcacccagaccgguucauugagugcuacauugccgagcaaaacauggu
gagcauugccgugggcugugccacacgugaccggacagugcccuucugcaguacuuucgc
ggccuucuucacacgggccuucgaccagauucgcauggccgccaucucugagagcaacau
caaccucgugggcucccacugugggugugccauugggaagacggggccccucucagauggc
ccucgaagaccuggccauguucggucagugccaaugucacugcuuuuuaccccaagcga
uggagunugcaacagagaaggcaguggaguuagcagccaacacaaagggcauuugcuucau
ccggaccagccgcccagagaaugccauuauuuauagcaacaaugaggauunccaggucgg
ccaagccaaggunguccugaagagcaaggaugaccaagugacagugaucggggcugnugu
aacucugcaugaggccuuggcugcugcagagagucuaaagaaagauaagaucagcauccg
ggugcuggauccuucacuaucaagcccuggacaggaaacucauccuagacucugcccg
agcaacaaaaggcaggaucucaccggaggaccacuacuacuaccaggaugcauaggaga
ggcagugucugcugccguagugggugaaccuggagugacggucacucgccuggcugucag
ccaaguaccacgaaguggcaagccagcugagcuacugaagaugunucgguauugacaagga
cgccauugugcaagcugugaaaggccuugucaccaagggcuagggagggcaugggaugcu
gggugguguaacuacacauuccagggaggunucuggcagagguggcgaagguguacugagu
ggggaggunaaauauauguuung TABLE 3-continued RNA transcripts up-regulated during HF stem cell activation.

SEQ
ID
No: Access. # Sequence

23 AW212475  uuaacggugucauaaauaaguaauauaacuuuauuaaaaugaaaagacaauauucaaaau
aaugcaacaaaaugaauaaauccuuuguccaauacuguacacacagugcggagaucagug
cauuuuucuaaagcauguuuuaaccuucauuuaguucauacuaaaguaagcuuuaaauag
cucaaauaaugucauucagcaguuuaaacugaacagcuuguugggacaug 24 V00835    ugaguucucguaaacuccagagcagcgauaggccguaauaucggggaaagcacuauaggg
acaugaugüuccacacgücacaugggücgüccauccgagccagücügccaaaggggcg
gücccgcgügücacacüggcgcuccaggagcucügcacuccgcccgaaaagügcgcücg
gcucugccaggacgcggggcgcgugacuaugcgugggcuggagcaaccgccugcugggug
caaacccuuugcgcccggacucguccaacgacuauaaagaggggcaggcuguccucuaagc
gücaccacgacüucaacgüccugaguaccuucccucacuuacuccgüagcuccagcuuc
accagaucucggaauggaccccaacugcuccugcuccaccgguaagacucccgauccuug
gucuuuagaauaccaaguugggaccgcagagcggaauccccgaguuguagaggcuuggcg
ggaauaggcaccuuuaguuggcgauucauuccgguucuuucuagaauccgcucuugcaaa
agccuucauuaguuacgaguauugucgaacgggüccuuuggcgggguugggcuaggauu
uagacgcgcaaaugüccgguccugaucacccaguuaguggggacaucuggguugaguсс
caggcauuacuaaacuuacugugaauugcuugaauuaagaaagaggügaaggaccuuuau
gücuugggacucaaagacauaauсссugacuuaaccugugaggagaaaagugggcuagg
cucccugcagcuccgaggaggacuuagügaacgагcсgggacucgügguguuggccacu
gcuguaaugcugcucсссucaügсügücuucuuucuccuccсaggcggcuccugcacüug
caccagcuccugcgccugcaagaacugcaagugcaccuccugcaagaagagугagüuggg
acaccuuggguggcggcuaaggcuaggggcggggaacüccuacaaaacüggcucugagaa
augüccuuugcüucccggaggccauüguauügücucggggacagaacuauacagagaacu
auuuaaaaaaaccgaggücuucucuguugggacaggaagcagaggücüucagccaggcu
gccucuccuccuucuuuсüaggcügcügсuссügcuguccсgüggggcugcüссaaaugüg
cccaggggcugugücügcaaaggcgccgcggacaagügcacgücugügccugaugügacg
aacagcgcugccaccacgüguaaauaguaucggaccaacccagcgucuuccüauacagüu
ccacccugüuuacüaaaccсccgüuuucuaccgagüacgüuaauaauaaaagccuguuug
agucüaacucuggüuucuggugügguuuggcaauaagaaacuggggügacuugauaguc
uggggaucugguuuuggaccсccucgügccuuuaccuccgcccucuggcccucacagagg
gguaaugucuuuggguaaagccaagcüauauсссauaagcuuccucauggaaaacagcüg 25 AV374868  gcggcacgаuguguсüucggguggcüuüuuüuuuuuugüuuugaauaauguuuacaauuu
cccucaaucacuuuuauagaaauccaccuccaggccccccccuuuccccacuuaggccuu
cgaggcugücugaagaugcuugagaaacucaaccaaauccсaguucaauucagacuuugc
acauauauuuauauuuauaaucagaaaagaaacauuucaguaauuuauaauaaaagagca
cuauuuuuuaacg 26 M21285    See above (same Accession Number).

27 U74683    acugccaucgaguggüguuccaguügaacuugcucucucugccaucugücсgсgggcgc
cgücagcauggguсссuggacccacuccuugcgcgccgüccugcugcüggügcüuuuggg
agucugcaccgügcgcuccgacacuccugccaacugcaccuacccсugaucugücgggcac
cügggüguuccaggügggcccuagaaguucccgaagcgacauuaacugcucgguggauga
agcaacagaagaaaaggüaguгgüacaccuuaagaaguuggauacügccuacgacgagcu
gggcaauuccgggcauuuuacccücauüüacaaccaaggcüuсgagauugüguugaauga
cuacaaauggüuugcüuuuucaagüauügaagücagaggccacagcüacücaguuacug
ccaugagaccaugacüggguggggüccaugaugücüggggccggaacugggcuugcuuugü
uggcaagaaggüggaaagücacauugagaaggüuaauaugaaugcagcacaucuuggagg
ucuccaggaaagauauücugaaagacucuacacucacaaccacaacuuugügaaggccau
caauaccguucagaagücuuggacugсaacugcauauaaggaauaugagaaaaugagccu
gcgagaucugauaaggagaagüggccacagccaaagggauccaaggccсaaaccсügcccс
gaugacugaugaaauacagcaacaaauuuuaaauuugccagaaucuugggacuggagaaa
cgüccaaggcguсaauüaugüügcccuguücgaaaccaagaaucuuguggaagcügcüa
cucauuugccücaugggüaugcüagaagcaagaauucgüauauuaaссaacaauucuca
gacaccaauccügaguccucaggaggüuguaucüugcagcccucüagсccaagguugüga
uggüggauuccсauaccücauügcagggaaguaugcccaagауuuugggguggüggaaga
aagcügcüuucccuacacagcсaagauucüccaugcaaaccaagggagaauugccuccg
uuacuauucuucugacuacuacuauggggügguuucuauggüggcügcaaugaagcccu
gaugaagcüugagcüggücaaacauggacccaüggcaguucuuuugaaguccacgauga
cuuccüacacüaccacaguggaaucüauacaccacacugggcugagügacccuuucaaccc
cuuccаgcügacaaaucaugcugüuüugcüugügggcuauggaagagauccaguuaсugg
gaüagaauacuggauuauaaagaacagcuggggcucuaacuggggggagagüggcuacüu
ccgüaucсgcagaggacgаugaaügcgсaauügagaguauagccgcuggcgccauacc
gauccuaaauuauaggacauagcücccagügüucaüacgggücuuuaucacücacaga
gügauuuaguсacaugcugaagacuuuucagagcaauсagaagcüuaccacuaagca
ucuuuaagaauuuugücuuugaacüuaaaaccauccuugauüuuucuuuüaauaücu
uсссaucaacüасugaacüacuuuucuuuuuuuuaaagüacuuggüuaagüaaüacüuuuauu
gagcagügggüucaguugüccaauaüuuuugcaggücauсuacaaугcaaccаgаugüuu
caguucuaaaaucüauguaaagüacaagcucgüuuuuaaauuugüaagücacaugаа
aacaüggcaaaaaauuagüuaaauüuuuacaaagaguuuaaauaaauguuuauguaа
ucaguaccaugücuucugügüguuuacaagaauuuüugücaccuacüucuccсuu
agaagcaüüuaugcüccauggacgüacüucuuuauggagaaaaaaaaaa TABLE 3-continued RNA transcripts up-regulated during HF stem cell activation.

SEQ
ID
No: Access. # Sequence

28 X61800     gagcucgaucccuguuccgccuuugcuaugucugaaggcguccugcuuugcgcgugucgg
              ggccaaauccagauuuucauuucgcuccaggcuuggacggcuaaguagguccaaaccgca
              caaacaggaaggagggaaggcaaggagugcgggcagagggcgggucguucccagcagcac
              cccaguccucccccgcuccgucuccgacccacugggggccggggcgggcgugcgcgucagc
              uggggcuagaaaaggcggcggguccggcccggcgaggugacagccaacuuggacgccaggu
              ccggccgacgccgccaugagcgccgcgcuuuucagccuggacagcccggugcgcggcaca
              cccuggccacagaacccgcggccuucuacgagccaggcagggguggacaagcccggccga
              ggcccgagccaggggaacugggggagcugggcuccacgacuccugccauguacgacgac
              gagagcgccaucgacuucagcgccuacauugacuccauggccgccgugcccacccuagag
              cugugccacgacgaacucuucgccgaccucuucaacagcaaccacaaagcggccggcgcg
              ggcggccuggagcugcugcagggcgggcccuacgcgaccccccgggugugggggucugucgcu
              aggggggccgcucaagcgcgaacccgacuggggcgacggcgacgcgccgggcuccccugcug
              ccggcgcaaguggcggugugcgcgcagacagugguggagcuuggcggccgcggcucagccc
              acuccaccccacuucgccggagccuccucgaggcagcccggggccgagccucgcgcccggc
              acaguccgagaaaagggcgcgggcaagaggggguccggaccgcgcagcccggaguaccgg
              cagcggcgcgagcgcaacaacaucgcugugcgcaagagccgcgacaaggccaagcgccgc
              aaccaggagaugcagcagaagcugguggaguugucggccgagaacgagaagcugcaucag
              cgcguggagcagcucaccgggacucggcucggccuccggcaguucuucaaaaaaacugccc
              agcccgccuuccugccgccaccggcgccgacugccgguaacgcgcggcgugggccuuu
              gagacucugaacgaccuauaccucagaccccgacagcggggagcagacgccgcccgaauc
              gcuaguuucuuugggaccugcgagcgacaggaagcugcagcuugggcacuggacugcgag
              agaagcuauauuaaucuuuccccuuaaauuauuuuuuauaauggguagcauuuucuacguc
              uuauuaccauugcagcuaaggguacauuuguuagaaaagacauuuccgacagacuuuugug
              auaagaggaagagacugcgcaugcuuuuuauauucauuuuuacaguauuuguaagaauaa
              gaauaagaauaaagaagcauuuaaaucgcaaaaaaaaa 29 U20735     Sequence below.
uugaggguggccaggccagcguaggaggccagcguaggauccugcugggagcggggaacugagggaagcgacgccgagaaa
gcaggcguaccacggagggagagaaaagcuccggaagcccagcagcgccuuuacgcacagcugccaacuggccgcugccgacc
gucuccagcucccgaggacgcgcgaccggacaccgggguccugccacagccgaggacagcucgccgcucgccgcagcgagcccg
gggcggccuucaggggaccuuuccagaucgcccaggccgccaggccgcccggaugugcacgaaaauggaacagccuuucuaucacga
cgacucuuacgcagcggcgggauacgucggagcccuggcagccugucucuacacgacuacaaacuccugaaacccaccuug
gcgcucaaccuggcggaucccuaucgggguucuaaggguccuggggcgcggggguccaggcccggagggcaguggggcaggc
agcuacuuucggucagggaucagacacaggcgcaucucugaagcuagccuccacggaacuggagcgcuugaucguccca
acagcaacggcgugaucacgacgcccacgccucggacaguacuuuuaccccccgugggggguggcagcggguggaggguag
agggggcggcgucaccgaggagcaggagggcuuugcggacgguuuugucaagccuggacgaccugcacaagaugaaccac
gugacgccccccaacguguccgugggcgccagcggggguccccaggccggcccaggggggcgucaugcugguccggagccgc
cucccgucuacaccaaccucagcaguuacucuccagccucugcacccucuggaggcuccgggaccgccgugcggacugggag
cucauacccgacggccaccaucagcuacccuccacaugcaccaccuuugcgggcggccaccggcacagcugggguuugaguc
gugggcgcuuccgccuuuaaagaggaaccgcagaccguaccggagcgcagccgcgacggccacgccgcgcguguccccccauc
aacaugaagaccaggagcgcaucaaaguggagcgaaagcggcugcggaacaggcuggcggccaccaagugccgaagcgga
agcuggagcgcaucgcgcgccuggaggacaaggugaagacacucaaggcugagaacgcgggggcugucgagugcugccgguc
uccuaagggagcaaguggcgcagcucaagcagaaggucaugacccaugucagcaacggcugccaguugcugcuaggggucaa
gggacacgccuucugagagcccucccuugccccaucggacaccccccagccuugaaggcugggcgccugccccccacgggggu
gaggggggcaggcgauggcaccgcccaaaaggccuggggcgcagucacacacauggacucggcccgccgcccgccugcgccca
guccuuccaccucgagguuuacauggcccccuuccagcguauuuugauguuuuuuuuuucugcaaagagacugaauucau
auugaauauaauauauuugugauuuuaacaggaggggagaagggggcugucgcggcggagcuggccgccguugguacucag
cugcggggauacuagggagggaccuccgcccccugccccuccccucugcauaguacuguggagaagaaacacgacuucgugu
cuaaagucuauuuuaagaugguguuugugugugugugguuugacuuuuuauugaaucuauuuaagua 30 U19118     Sequence below
gaauucggcacgagcagcgagacgccgcgcacggugcuuccccaguggagccaaucggcuaacccgcgcuccggcagaguccc
uuggcgcucgccgccggcgggacagaccaccgccucuggccgcucucuggaccuggccgccccgagcgaagacuggagc
aaaaugaugcuucaacauccaggccaggucucugccucagaagucagugcgaccgccauugcccccugccucucaccuccug
ggucacugguauuugaggauuuugcuaaccugacccuuugucaaggaagcugagauucgccaucagaauaaaacaccu
cugccaucggaugcucucgcugcuggagucaguuaccgucaacaacagacccguggagaugcagucaccaagcugaggcg
gccccugaagaagaugagaggaaaaggaggcggcgagaaagaaauaaaauugcugcugcaagugucgaaacaagaaaaagga
gaagacagagugccugcagaaagagucagagaaacuggagagugugaaugcugagcugaaggcccagauugaggagcugaag
aaugagaaacagcauuugauauacaugcucaaccugcaccggcccaccuguaucguccgggcucagaauggacgacaccgg
aagcagagaggaaccucuuuauccaacagauaaaagaaggaacauugcagagcuaagcagaggugggcacggaggcaauuggg
gaguucuuacugaauccuccuuuuccaccccaaccacacccuggaagccauuggaaaaucuggccucucugugcauuucuagaauccca
gcagccaagagccguugggcaggagggccugugggugaccuacgcauugacccacucccccgagugaaccguggagca
ggcaggagcaucccuuugucucaccaauuccaggauuuaggccuuaucauccggccagucucagaugaccuagcuggcccca
ggcuggggugccuaugcaaagcaggaucccacuaauggggauucaggcagaagugcuaccuugauaggugggguggaccac
auccucuacuguggcugacaacgccccuucaagggaauauggaaugagaacauucauuauugagguugucccaauggccaggg
uaugcuuuucuagaaaaauaugcuguuucuucccagaauggcuaaugguagauucgcuuucagagccuggugugcuau
uuagauguuuugucuugcacaacauuggcaugauuuuccgggaguuucaucagaucgauuuucugagagucugggggaucu
gccauggugaaagugccccucaaaagcauuuuguguggcacaugaacuggcuggcaccaggggagugaaacggcugauga
ccagcugagccacuuugugccaacagaggauggacgacaccuuucccuguacccacugcagaggaagaacccggggcacagca
gcuuugucuuggcuacaaacuguuacaacgucacacaaugaaggcacaaagcuaacuuucaaggguguaggacuccaua
cucagugacagggcaggaagagccaaagauaaccacagccacagccuguggagaccaggguuggaagccaggugcagggcca TABLE 3-continued RNA transcripts up-regulated during HF stem cell activation.

SEQ
ID
No:Access. # Sequence ggcaucugcauugugggauguuaauggcacuuuugucuuguagcuauuuugagaugugguccagagcauuucagcuggga
gaucucccucuggccaccaggacucuggcuacuguuaaaauccgauguuucuguggaauccucaguguuuaauccacuca
auaguaucauuacaguuuucuguaagagaaaauauuacuuauuuuaucccaguauuccuagccugucaacauaauaaauaucg
gaacaaaaccuggua 31 AW049031    uuuuuuuuuuuuuuuuugcugauaagaauucuuuuuauguuauucgaauaaaaaauaca
               uucauacagaaauauaacaaucucgcaaaaaacaauuucaaauaaaaucuuguaaaacaaa
               auuuuacaaaaaucuuacaaagauucuuuuagauaacagggugcuucaaaaaaaaagaaau
               aaagaaaauuucacuaauagaaauuuuuuuuuuaauuucaagcaaaaguuccugcuugau
               ugaggcucaguugucaccugaccagaauggacugcuuaguauuaaaguuacagcaucgac
               acggacggcacccagccccagccagaccagcaacgucgcugugguuucauaagugagacgc
               gccagcacaaguuuccucucucuuucguuuaccuucuuacuuaauggaauugcuauggau
               aagcacacagcagggccaaaaaaggaguuuuccaaaauccagcaaaucaagug 32 M93275      uaguggugaucuggaccgugcggacuugcucguccccucagcucuccuguuaggcgucucu
               uuucuccaggaggaaaaaauggcagcagcaguagguggauccgcaacagagcguggugaug
               agaguggccaaccugcccuuggugagcucuaccuacgaccuugugaccuccgcuuauguc
               aguacaaaggaucaguacccguauuugagauccgugugugagauggccgagaagggcgug
               aagaccgugacucucgcggcaugacaagugcccugcccaucauccagaagcuggagcca
               caaauugcgguugccaauacuaugccugcaaggggcuagacaggauggaggaaagacug
               ccuauucugaaccagccaacguccgagauuguugccagugccagaggugccguaacuggg
               gcgaaggaugugguagacguaccauggcuggagccaaggauucuguagccagcacaguc
               ucagggguggaugaagaccaaaggagcagugacuggcagcguggaaaggaccaaguacu
               guggucaauggcagcaucaauacaaguuuuggggauggugcaguucaugaacagugagua
               gauaaugccaucaccaagucggagaugcuggauagaccaguacuucccucucacucaggag
               gagcuggagauggaagcaaaaaaggugguaaggauuugauaugguucagaagccgagcaac
               uauagaacggcuggagucccugucuaccaagcucugcucucgggcuuaucaccaggcucuc
               agcagggguuaaagaggccaaacaaaagaagccaggagaccauuucucagcuccacuccacu
               guccaccugauuugaauucgccaggaagaauaugcacagugccaaccagaaaauucagggu
               gcucaggauaagcucuaugucucgugggugagugggaagagaagcaucggcuacgacgac
               accgaugaguccacugguguugagcacaucgagucacgucucuggcuaucgcccgcaac
               cugacccagcagcuccagacuacaugccagacugucccuggucaacgccccaagggguuacca
               cagaacauucaagaucaggccaaacacauugggggugauggcaggcgacaucuacuccgua
               uuccgcaaugcugccuccuuuaaggaaguguccgauggcguccucacaucuagcaagggg
               cagcugcagaaaaugaaggaauccuuagaugaaguuauggauuacuuuguuaacaacacg
               ccucucaacuggcgguagguccuuuuauccucagucuaccgaggugaacaaggccagc
               cugaaggccagcagucgaggucaaagcucaguaaaccccuccuuugucaccagagcaug
               auguugcuggccagaugaccccuuuugcuguauugaaauuaacuugguagauggcuuuag
               cuuagaaaagcagcuucuuagaaccaaggccucauuauggucacucacagcucaguuau
               ggucuugcccccagcuggcccuggcacaggaguucucuuaccuggcuggugagguggccgu
               guuagucuugugaggaccuggaggaaccuaaaagcucagaugcacuuacagucuugucug
               uggccuuuguauuguuauuggcuguaaacgucugucuggaccgaauaaagauucacguga 33 AB000713    ggcacgagggagcugcaguguucgcgcuugguagcugguggcaucggacucagcugguuu
               guguccccugaggcucaccgaaaaacacuuuucucagcccucugacuccagagagagagaga
               gagaggguacuuuuugguggucaccgacuuugacccccugcagaggcugagcgauggcgucua
               ugggacuacagguccugggaaucuccuuggcaguccuggacuggcuggggaucauccuga
               guugugcgcucccauguggcgggugaccgccuucaucggcagcaacaucgucacggcac
               agaccagcugggaggcgcucucggaugaacugcgguggcagacaggucagaugcagu
               gcaagaugacugacgacucugcccugccgcaggaccgcaggccgcccgagcccuua
               uggucaucagcaucaucguggugcucuggaugcuucucucaguggaggggcaagu
               gcaccaacugcauggaggacgagaccgucaaggccaagaucaugaucaccgccggagccg
               uguucaucguggcaagcaugcugauuaauggugcccgugcccgucacaacgguca
               uccgcgacuucuacaaccccuauguggcuuccgggcagaagagggaaaugggggccucgc
               uuuacgucggcuggcgggccuccgggcugcugcuccugggaggaggccuccucugcugca
               guugccaccucguagcaacgacaagcccuacucggccaaguacuccgcgcccgcucug
               uccccgccagcaacuaugguaaggugggccacucugucgccaauugccuuuuguauuuuuu
               uuucggauugagcucauaacagccuggggcccccucacauuucucaggaccugcccugcua
               ugggccacuaacugcuugcuggggacaggcaaacccggacugugcaaaguuacuagcccg
               uagcucuugggcugcuccacauggcuccuuacgccggcaagaauggaguaaaaauauc
               uugcugcuuacauccaaauugcgguggauaugggcugaaggcagaagcagcugggaaggg
               caguagaggcgcaagcuggguccugcugccggguagcucagcugugacuuuggacucg
               gaguggaugucucauguuagcaaacguccacugucuuucucuauccccucacucagc
               cuacacguuacuccagcgcuacucuugccauuacgccccguguuuccgagcacagcuggu
               ccuaccccaagucaugguguagagugacugauggggcauugagagcggugggcu
               cugccauggaacccuuccguugauuagcaaugacugugcuugacccacccaccuacccua
               cuaaugaauuucguagauggauggacggguugagggaagaagggugaggggauu
               aaacugguuuggggaggcuggggaccuagaagcagcccagugugucccaccccuuuucc
               gcacugucuugcuaaauguucugucucaugugcgccccuccccucacagaaggaccccugg
               gccucuugaguuggcccucugaguccucccuuugcccauuucaaggacaccggcag
               ucugcgaaggaagguacgggggggggggggggggugauggcauuugaccaggggagc
               uccuggacuccccugccuucucguggguucuuguuuugaauuaaggucuguucacagc
               uguaauuauuauuauuuucuacaauaaauggcaccugcauacag TABLE 3-continued RNA transcripts up-regulated during HF stem cell activation.

| SEQ ID No: | Access. # | Sequence |
|---|---|---|
| 34 | U20735 | See above (same Accession Number). |
| 35 | U83148 | augcagcugagaaaaaugcagaccaucaaaaaggagcccgcaccccuagauccuaccagc agcucagacaagaugcugcugcugaacucugccuuagcugagguggccgaggaccuagcc ucaggugaagauuugcuccugaacgaagggagcauggggaaaaacaaauccucggcgugu cggagaaaacgggaauucauuccggacgagaagaaagacgccauguauugggagaaacgg cggaaaaacaacgaagcugccaaaagaucucgggagaagcgccgccucaaugaccugguu uggagaacaagcugauugcccugggagaagaaaaugccacuuuaaagcugagcugcuc ucccugaaauuaguuugguuuaauuagcuccacggcguaugccaagaaauccagaaa cucaguaauuccacagcugucuacuuucaggacuaccagacauccaaggcugccgugagc ucuuuuguggacgagcaugagccugcgaugguagccggaaguugcaucucagucaucaag cacucuccccagagcucgcucuccgaugugucagaggugucucgguggagcacacucag gaaagccccgcacagggaggcugccggagcccugagaacaaguccccugugaucaagcag gagcccguggaguggagagcuuugccagggaggccagggaggagcggggcacguauucc accuccaucuaccagagcuacaugggaagcucuuucuccacuuacuccacuccccaccc cucuugcaggucccauggguccacuagcaacuccccaagaaccucagaggccgaugagggu guagugggcaagucuucgaugggggaagacgaacaacagguccccuaaggggcccauccau ucuccaguggagcugcaacggguucacgccacgguggugaagguucggaagugaacccu ucugccuuaccgcacaagcuucggauuaaagccaaggccaugcagguccaaaguggaggcu uggacagcgaguuugaaggcaugcagaaacucucuucaccgccgaugcgaucgccaaa agacauuuugaccuggagaaacauggaaccucgggguauggcccauuccuccuccuccu uucucagugcaggugacgaacauucaagauuggucccucaaaucggaacacuggcaucac aaagaacugagcagcaaaacucagaguagcuucaaaacaggugugguggaagucaaagac gguggcuauaagguuuccgaagcugagaauuuguauuugaagcagggaauagcaaacuua ucugcagagguggucucgcucaagagauucauagccacacaaccgaucucggcuucggac uccagguaa |
| 36 | L10244 | gcucccgggaaacgaaugaggaaccaccuccuccugcguucaaguacaggggccugguǵ cgcaaagggaagaaaagcaaaagacgaaaauggcuaaauuuaagauccguccagccacug ccucugacugcagugacauccugcgacugaucaaggaacuggcuaaauaugaauacaugg aagaucaagucauuuuaacugagaaagaucuccaagaggauggcuuuggagaacacccccu ucuaccacugccugguugcagaagugccuaaaagagcacuggaccccugaaggacauagca uuguugguucgccaugauacuauuuuaccuaugacccauggauuggcaaguugcuguauc uugaagacuucuucgugaugaugauuacagaggcuuuggauaggaucagaaauuuuga agaaucuaagccagguugccaugaagugucgcugcagcaguaugcacuucuuggúuagcag aaugǵaaugaaccaucuaucaacuucuacaaaagaggagguucggaucucguccagug aagagggauggaggcucuucaagauugcaaagaguacuugcuaaaaauggcagcagagg agugaggcgugccgguguagacaaugacaaccuccauugugcuuuagaauaauucucagc uucccuugcuuucuaucuguguguagugaaauaauagagcgagcacccauccaaagcu uuauuaccagugacguugugcauguuuagaaauucggucuguuuaaaguggcagucaug uaugugguuuggaggcagaauucuugaacaucuuuugaugaagaacaagguggguaugauc uuacuauauaagaaaaacaaaacuucauucuugugagcauuuaaauguguacaaugaca cacugguacuuagaguuucuguuuugauucuuuuuuuuuaaauaaacucgcucuuugau uu |
| 37 | U88328 | cgcuggcuccgugcgccauggucacccacagcaaguuucccgccgcgggaugagccgcc cccuggacaccagccugcgccucaagaccuucagcuccaaaagcgaguaccagcugguǵg ugaacgccgugcgcaagcugcaggagagcggauucuacuggagcgccgugaccggcggcg aggcgaaccugcgcagcgccgagcccgcgggcaccuuucuuaccgcgacagcucgg accagcgccacuucuucacguugagcgucaagacccagucgggǵaccaagaaccuacgca uccaguguǵaggggggcagcuuuucgcugcagagugaccccgaagcacgcagccaguuc cccgcuucgacuguguacucaagcugguǵcaccacuacaugccgccuccagggaccccccu ccuuuucuuugccaccacggaacccucguccgaaguuccggagcagccaccugcccagg cacuccccgggaguaccccaagagagcuuacuacaucuauucǵggggcgagaagauuc cgcuguacugagccgaccucucuccuccaacguggccacccuccagcaucuuǵucgga agacugucaacggccaccuggacuccuaugagaaagugacccagcugccǵuggacccauuc gggaguucuǵgaucaguauǵaugcuccacuuuǵaaggagcaaaagggucagaggggggcc ugggucggucǵgucǵccucǵucuccǵaggǵcacauggcacaagcacaaaaaauccagcccca acggucggǵuagcucccagugagccaggggcagauuggcuucuuccǵucaggcccuccacuc ccgcagaguagagcuggcaggaccuggaauucgucugaggggǵagggggagcugccaccug cuuucccccǵuccǵccagcuucagcuucuuucaaguggagccagccggccuggccuggǵg ggacaauaccuuugacaagcggacucucǵccccuccccuuccuccacaccǵccǵcucǵgcuucc caagggagguggggacaccuccaagugugaacuuagaacugcaagggǵgaaucuucaaac uuucccgcuggaacuuguuǵgcguuugauuǵgguuǵgaucaagagcaggcaccugggǵg aaggauggaagaaaaǵggugugugaaǵggúuuuuuaugcuggccaaagaaaauaaccacu cccacugcccaaccuaggugaggaguggugǵgcuccuggcucuggggagaguggcaaǵggg ugaccugaagagagcuauacuggugccaǵǵccuccucǵccauggggcagcuaaugaaaccu cgcagaucccuugcaccccagaaccccuccccguuguǵǵaaǵagǵcaǵuagcauuuagaagǵ gagacagaugaǵǵcugugaǵǵcuggccgccaucaacaccaaǵgaǵǵaǵǵcaǵaucaac agaugaǵǵcǵcaucuuǵǵagcccaǵǵguuucccǵǵagcaǵaǵuǵǵaǵǵǵuucǵcuuuǵucu cuccuauǵuǵgggcuaǵǵǵagacucgccuuaaaugcccucuguccǵagǵǵauǵǵǵǵauuǵg cacacaaǵǵaǵccaaaacaǵccaauaǵǵcaǵaǵaǵuugaǵǵǵauucacccagǵuǵǵcua caǵǵccaǵǵǵǵaaǵuǵgcugcaǵǵǵǵaǵaǵacccaǵucaccaǵǵaǵacuccuǵaǵuua acacuggǵaagacauugǵccaǵuccuaǵucaucucǵuǵcaǵuagǵuccǵagagcuucc |

TABLE 3-continued

RNA transcripts up-regulated during HF stem cell activation.

| SEQ ID No: | Access. # | Sequence |
|---|---|---| aggcccugcacagcccuccuuucucaccuggggggaggcaggaggugauggagaagccuu
cccaugccgcucacaggggccucacgggaaugcagcagccaugcaauuaccuggaacugg
uccugugugggagaaacaaguuuucugaagucagguaugggggcugggugggg cagcu
gugguugggguggcuuuuuucucucuguuuugaauaauguuuacaauuugccucaauc
acuuuuauaaaaauccaccuccagcccgccccucuccccacucaggccuucgaggcugucu
gaagaugcuugaaaaacucaaccaaauccccaguucaacucagacuuugcacauauauuuau
auuuauacucagaaaagaaacauuucaguaauuuauaauaaaagagcacauuuuuuaau
gaaaaaaaaaaaaaaaaaaaaaaaaa 38 X82786   Sequence below.
aaggaaucuucaguacagaaacaagacccaaguguaaguuuaacuggcaggaggaaccaaccaaggacaguuaaggag
aaaacccaacccuuagaagaacucaccaguuuccaagaggaaacugccaaaagaauaucuuccaaaucuccacaaccgg
aagagaaggaaaccuuagcagguuaaagaggcagcucagaauacaacuaaucaacgauguguaaaagaagagccca
cagcacagagaaagcaaccauccagggaaaccaggaacacacucaaagagccuguaggugacaguauaaaauguugaag
agguuaagaaguucuacaaagcagaaaauugauccaguagcaaggcaaguguugcucaagaggccacggagggguaccc
aaggaaaggcacaggcccuagaauuggcuggucucaaaggaccaauccaaaccuuaggccacacugaugaaucagca
agugauaaaggacccacacagaugcccuguaauucucuacaaccagagcaaguugacagcuuccaaagcucaccaagg
cgacccaggacaagacgugggaaaguagaggcagaugaagagccuucagcaguaagaaagacaguaucaacaucaagg
caaacuaugcgaucccgcaaggucccugaaauugguaacaauggauguaccccaaguuucaaaggcuccauaaagcagaca
uuagaucaguagcaaaguaacugg cagcaggaggcagcuaaggacacauaaaggaugggguucaaccccucuugaa
guuguuaggugacuccaaagaaauaacccaaauaucagaucacucugagaaacuagcacaugacaccaguauccuuaa
gagcacucaacagcaaaagccagacucaguaaaaccucugagaacaugcagaagagugcugagggccucuaaagaggu
ccccaaggaaguguuugguggacaccagagaccaugcaacaauuacaaagcaaaagcaacccuuugcugucccccgaagag
gaagucugcaagaugauggaagcauugugagaaccagggcuuugcgcucuuuuagcaccaaagcaggaagcaacagaug
agaagccuguaccugagaaaaaaagggcugcuuccagcaagaggauguauccugagccugugaagaugaaacacc
ugaaaucugucaaacaaacuugaaucuguggaagagcagguuagcacuguuaugaaaacagaagaaauggaagcc
aaaagagaaaauccugucacuccagaucagaaacucuaggaccgaaagaaaaaccaauguaaaacagccaaggcccaagu
uugaugcaucugcagagaaugucgggauaaagaaaaacgagaagacuauggaagacugccuccaggagacagagcug
cagaauccagaugauggagccaagaaaucuacaucucgggccaagucagugggaaaagaacaugcuugaggucuag
aggaacgacugagaugcccagccuugugaagcagaagagaaaacaagcaaaccagcugcagaaaucuugauaaagcc
ucaggaagagaaaggagucucuggagagucugauguuagguguuugagguccagaaaaacuagagucgcuuggac
agugaaccuaagccaagggu aacucguggaaccaagaaagaacugcaaaaacucagaaggaggaugaagacauuguaugc
accaagaaguuaagaacaagaaguuaagaacaagaaguuaccagaaaagugaaacuauguagcaaagacauuuaagaa
ggaaaaguaaauuugacuuagugauaaguuccagugugguuucaccuccagugaaagaugaacuguaaauacuac
ugcuacugccugaguuuaaggaaggaagcuuugagcuuuccuggucauacucucuucagacgccaauggaggucau
gaggaagaucaccagggaucucagcgcaauuacaguuuaggggugagcaggcagaaaugugggcccucugccuaucc
aauaaagcucugaaauucgcugccaaaa 39 AW122523 uuuuuuuuuuuuuuuuuaaaucaaaaguuaugaugacuuuauuuuaaaucuuaauacacc
aaaaauauuuuucaauguugugagauaagcacuugaaaauaagaauuccaacacugcugu
gauuucgcugugaggcuugauagugaauuuccccucugaauaugggguuuagggccuagga
agcagaaugccagucauuuuccaaguagcagugagcuaagcccagcccggucaugcucag
acccacacuuaacugaaauauucacacuaggaggcggcaccaccaggcaacaccuugauc
aaccaggagaacaaaagucugaagugccaccaagcauugggaaagauauuguuuagau
gcuagugagucagguucuuucaaaugugu ccuaacuggguugcaaacauaguugcauccu
uau 40 AI642048 gucuguaaaaucuguuuaauaaauauacaucuuagaaguaccaaaauaauuaccaacaa
aauacaacauauacaacauuuacaagaaggcgacacagaccuuaguuggggcgacuuuu
aagcacaugccacugaacaccuggcucuuacaugggaggacacacugggcucacuuacua
ggucuaugguguucaaucaaaagcacaauaaauaaaacgugguccuuucauuagguucu
ggaaaaucaccuccccccccccaaaaaaaaucccacaaacaugaaccuuaagagacauu
uucuuugaauuucagugaucuguuccccggauuucacaaagacaacagccgaaucaccc
caguaaaaugccugggucuaggcgcugugugguguggugcuaaguauacccuuucucauu
uuuuuucuuuuucu 41 L07264   cggccgccagaccuucaagggcuggagugacgcgcggaccgacucugaacagacagacg
aaccgcggccgcaagguucccagacaggaucucacccagaggcaggcagcggacagugcc
uuagugga accucgcugu ccuccaccgccuggccccggugcaggugccagugg ccgccg
cauccaaagugaucgcugccuccccgucuccgccagcucgggaccaugaagcugcugccg
ucgugaugcugaagcucuuucuggccgcaguguugucccgcugggugacacggugagu
cuggagcggcuucggagaggucuggcggcagcaaccagcaacccugacccucccacugga
uccacaaaccagcugcuacccacgggaggugaucgugucaggggguccaggacuuggaa
gggacagaucugaaccuuuucaaaguugcuuucuccuccaagccacaaggccuggccacc
ccaagcaaagaaaggaaagggaaaaagaagaagaaggaaagggguuagggaagaagaga
gacccaugccucaggaaauacaaggacuacugcauccacggggagugcagauaccugcag
gaguuccguacucccucuugcaaaugccucccugguuaccacggacacaggugucaugg
cugacucuaccagugga gaaucccc uauacacauaugaccacacuacagucuuggcugug
guggcuguaguacugcugccgucugucucuucuaugcaucugugagugacucucaugu uuag
guaccacaggagaggagguuaugcuuggaaagugaagagaaagugaaguugggcgu ggc
uagcucccacugaggaggaccugagcuauaggaaccuucagaggcuacuucugagacagug
guucguuacacgucuacauagaggagaauauuucaccagcagccaugaaaacgucuuc
auucauuuccaguugcuacccugacuggg cc ucc ug uaau TABLE 3-continued RNA transcripts up-regulated during HF stem cell activation.

SEQ
ID
No:Access. # Sequence

42 M15668  ucgaccucacggucuugccaaaaugucgcuuuccaacaagcugacuuuggacaagcugga
cgugaaggggaagcggucgugaugagggugggacuucaacguuccuaugaagaacaacca
gauaacaaacaaccaaaggaucaaggcugcuguuccaagcaucaaauucugcuuggacaa
uggagccaacuccguugccuuaugagccaccugggccggccugaugguguucccaugcc
ugacaaguaccucuuagagccaguugcugcugaacucaaaucucugcugggcaaggaugu
ucuguucuugaaggauugugugggcccagaagucgagaaugccgugccaacccagcggc
ugggacugucauccugcuggaaaaccuccgcuuucauguagaggaagaagggaagggaaa
agaugcuucugggaacaagguuaaagcugagccggccaaaauugaugcuuuccgagccuc
acuguccaaacuaggagaugucuaugucaaugaugcuuuugggacugcacaccgagccca
uagcuccauggugggugugaaucugccacagaaggcugguggauuuuugaugaagaagga
gcugaacuacuuugccaaggcuuuggagagucucugagcgaccccuuccuggcuaucuugg
aggcgcuaaaguugcagacaagauccagcugaucaauaaugcuagacaaagucaauga
gaugaucauuggugguggaauggccuuuaccuuccuuaaggucccucaacaacauggagau
uggcacaucucuguaugaugaagaaggagccaagauugucaaagaucucaugccaaagc
ugagaaaaaugguguggaagaauuaccuugccuguugacuuugcacugcugacaaauuuga
ugaaaugccaagacuggccaagcuacuguggccucugguauaccugcuggcuggauggg
cuugacugugguacugagagcagcaagaaauaugccgaggcugugggucgagcuaagca
gauuguuuggaauggccuguuggggauuuugaaugggaagccuuugccaggggaaccaa
gucacucauggaugagggugugaaagccacuucuaggggguugcaucacuaucauaggugg
uggagacacugccacuugcugugccaaauggaacacagaggauaaagucagccauguga g
cacugggggcggugccagucuagagcuccuggaagguaaagucuuccuggggugga ugc
ucucagcaauguuuagua uuuucuuuccugccuuugguuccugugcuccuaagcuaaccu
gcuguuuccacaucuccauuuggugu uagcgcaagauucagcuaguggcuga gaugugg
cacagaccuuaacagugcaagca ucucagcucgucuuacugcaucagaugcuggu ucuuc
aagaucccauuuaaauuccuuagugacuaaaaccauguguccauguaga gggcgucuauu
uauauucgccugagaaaggaagugagcuguaaaggcugagcucucucucugacguaugu
agccucugguuagcuucgucacucacuguuccuugacucagcauggcaaucgaugaaauu
cccagcuguaagucugcagaaauuuccgaauuc 43 AI047508  uuuuuuuuuuuuuuucauguuuaauaguuuauuucuuauuuuguugcuuuauaucuuc
aauaaaucauuuugcagguuuuguuacagauuuuugauaagccaacucaaguacugauuu
uucauccucucucugaaaguuuuaaaccaggaaaggaaaacguuccauggaauccaucuucca
cauggugaugagcucacaugaacuccaacauucugaagccgcuugacauacaugaguccauc
aucucuuaggacaucuacuggcaagugaugauauaggucuuaggua aaugaugcaauau
auugucauuggccaacagagggcaugccuucacaucuaugaacccuggauacuuuugagc
cagcucagaacuaccaggagugggauuuuuguaaacgggacuuuucuuguaucucucagg
gagcaaggaacuccaauucacaaacuguaacaaguggcuagauuccauggguacauguug
guuga 44 AJ001418  Sequence below.
gagcacccgggacccugggaccacaacgcacuugcucccucucgaccgcgcuccugacccgcagcccucgccaacccuacgga
uccuaaccaccgccagccuagguggcgucaggaugaaggcagcccgcuucgugaugcgcagcgccagcucgcugagcagcg
ccagccugguccccaggg aggucgagcuguucucccgcuacagcccgu ccccgcugucc augaagcagcugcuggacuuuuggg
uucagaaaaugccuguga aagaacguccuuuugcuuuucgcggaagacugccc gccgccuggccaaggcacacaaccugaaggag
auugacauccugccugaccgc uuuagugaacacuccuuccggug cagcuggugaagagcuggauauauccagagccugauggau
uuggug gaguuccaugagaagag cccagaagaccagaaagcccugucagag uuuguagacacgcuggucaaaguucgaaaca
gacaucauaaugugguccccuacaauggcucaaggcauccggag uauaaagacaccugcacaguggaccccguuaccaaucaa
aaucuucaguauuuuuuagaccgguuuuuacaugaaccgcuuuucuacgcggaugcuaugaacagcacauccacauauuca
gugacucaaagacgggaaaccca agccacauuggaagu aucgacccaaacugaugugggua gcagu agccaagaugccuu
ugagugugcaaagaugcucucgcgaccaguauuaucuaa caucgccagaauuaaa accucacacaaguca augga aaauu ucca
ggccaaccaauccacauuguacguuccuucacaccuucaccacaugcucuucgaacucuucaagaaugccaugaggg ccac
ggucgagcaucaagaaaaccgu ccuucccuugacccccaguagaggccacugucgucuuugggaaaagaagaccuuacaaucaag
auuucugaccgaggagg ccgguguccucugaggauuacugagccggagugc cggacauccccacugcccaacaccug
ugauggacaauucccggaaugccccuuuggcugguuuuggu uaugg cuugccaa uuu cugucucuacgccaaguauu uuc
aaggagaucugaaucucuacucu augucagguuaugggacagacgcuaucaucuacuuaaaggcuuuauc uucugagucug
uagaaaagcucccagucuuuaacaagucagccuucaaacauuaucagaugagcuccgaagcugaugacuggug uaucccaag
caggg accgaagaaccugg cgaagg agaagcuggcggguggaag cggaagagccguagcauuuuuaggggauucaaaguggg u
cugugg cauucugcuucgugaaugugugugg acucuaguuuccgcaaaacaaccgcaacacaaaaccaagcaagcaaaacaca
aacacgaguacaaaccuugaccugaugagggacagacuugguuggaugacccgggagaagucagggcagggcuccagggga
uaacaggu gu ccu gcuuucccu uuggcaaugcaaaaugacucc ugacuguuccaaauacugaaaagaag ucugccucugagu
uacagcucuuucucaacaaguacagaguuuggg cuugcaguug caacagcu ggugauguggggu ucug cug ccagcca
aauaaauuggu gu uuagug aacauuu ucaguguuucccgccaug caaagucuugg cgccuuggggag aaaugugu guaaaug
uacauuguauagg uauuaguguguc ucuagaaag gacagg augg aaggaaucaaagcacuuuaucg agcuuggcug agc a
uugcagccuaugug caaacccagagg aaaaguaucucug ucaagacagcuccag uaucaugcagcu uuuuauguuugcacuc
aaaaag ccaguguccuucugg cuggucgagg cuugggugaaaauguuuaaauaugc acugaccuc agaaagucgag uucaaa
gggagauaaaauugccaaaguga uccaagg auug ucaug uuggg aaaccccaug agaa aggauucucauacuug aac
uuuccuaugaagaaaugguggu aaacuuucucuaccuagaaguaguggaaauuucaagguc aucuuaaaaaagaug ugcgu
uguauauuuua acua cau ucucuacacucuaaacauu aacauau cuauuca aauuugcuaguugccaauugucuucagagu
gugaaau uuuaaaucucuug aagaauc uuu cugagaguguaag ga aaauaagu cuucauaucag gag ugucau
uuguaagcaugggg acau caug aacuagug augugcgugagg cuugg agg cug aaggguaaggaucg cgggaggccau
ccaug uag gagag aaauaaaacgagg agcg aggugaagcaauggag agaggg aag caagaaagg aaccagaaggcugg cau
cauccuauuccc acagg cuaaaccc aaggg augcu cu cug ccu uuccugg ggagggaaggggg ug aacug guag auuug aa
agcagu auggcuucuucug ugggucuccc ucuu acug acaagg ug aaaug auaau ucguguc aaauuaaugug aaauuuu
uuuccugcauug uaau auu augaggccug agucgcagu ugaguuu gaaauuug uauu uaauuu cacagu gaccuag agcu a TABLE 3-continued RNA transcripts up-regulated during HF stem cell activation.

SEQ
ID
No:Access. # Sequence aggugcucccgguuguggcaauaggagccacaaguauuucuuucuuucuuucguucuuucuuucuuucuuucuuu
cuuucuuucuuucuuucuuccuuccuuccuuccuuccuuccuuccuuccuuccuuccuuccuuccuuucuuuucu
uuucucuucucuucuuucuuuucugcuucuuuucuuuuuugcauuguagauguguccuuaaaagaucagggca
gugacuuucacagcaggacuuugacucccacauugguugaucacacaaaacugucagcauuuggguaaucgauguauagu
uguuugcugcugauguuccauugaaauuucagcucugaguuugugcacaugaauacuacuugcuguuuaccaaagguc
uaaggcauuugguuacuuaacccaaauauccugaacugugcguaaaaguaaauagagaaaagcuuuaggggcucaauagugca
ccugguguaaaaucaaaucaaaaaagccuuccauauuauuuaugaacccauggggagacuuuaaacucuuguagauga(u)gcuaa
augcccaggccacuuaacuuauuaaugugugaauuacauuuauguuuuuaguuuauaugcaaagaauugugauaauuuua
uaauaaauauuuuuauuauaauagu 45 AI838080  uuuucuuuuuuuuuucuucucuuuuuucugccaccaacagcacugugcaguuuauua
             accauucaugucacaguagccaucuggggagauugggacagaauugggaucgcaaagugga
             uagauauucagcaucuaauggguuggcagaagccgccauauacucuucacaaauaucuucc
             acagucaauacagaacuagccauuauccacagcacaccgauuugugc 46 AF072127  agccaggagccucgccccgcagcugcacagagagcaagggguauaggcacuaacuuguuug
             cagagaccccaucaccuucgggagcucaggugcgcaccuugcaaacuccacuuucugcau
             cugccacugagcccgcgggagccucgaaagagccauggccaacgcggggcugcagcugc
             uggguuucauccuggcuucucugggauggaucggcuccaucgucagcacugcccugccc
             aguggaagauuuacuccuaugcuggggacaacaucugugaccgcucaggccaucuacgagg
             gacuguggaugccucugcguuucgcaaagcaccgggcagauacagugcaaagucuucgacu
             ccuugcugaaucugaacaguacuuugcaggcaaccccgagccuugauggaauuggcaucc
             ugcuggggcugaucgcaaucuuuugugccaccauuggcaugaagugcaugagguugccugg
             aagaugaugaggugcagaagaugggauggcugucauuggggcauaauauuuuuaauuu
             cagguucuggcgacauuaguggccacagcaugguuaugggaaacagaauuguucaagaauucu
             augaccccuugaccccaucaaugccaggaugaauuuggccaggcccucuuuacuggcu
             gggccgcugccucccucugccuucgggagugguccuacuuucugcuccuguccccgga
             aaacaaccucuuacccaacaccacggccuuauccaagccaacaccuucuaguggggaaag
             acuaugugugacagaggcaaaggaagagaucuuccuggagcaaauacaaaauggacauug
             aaccuaggauugacauuaacgccuuagacuguugaugauggguuaucggaacuguguagaa
             acagaaggaagcauauuuuuauacauccccauggcuaugcaggccuuggcug 47 X80417  Sequence below.
cggcacgagcggccacugaccgagaagugccccgccuggagucagccuggggcaggccagggucccaccagacccc
gggaugaccgcagccagucgggccaaccccuacagcaucguaucaucagaggaggacgggcugcaccugguuaccau
gucaggcgcaacgguuuuggcaauggcaaggcauacgcgccgggccgcaaccgcuucgucaagaagaacg
gucagugcaacauugaauucgccaacauggacgagaagucaacgcuaccuggcugacauguuuaccacgugugug
gacauccgcuggcgcuacaugcugcucaucuucucucuggccuuucuugccuccugguuguuguuuggcaucaucu
ucuggggucauugcugucgcccacgggaccuggagccagccgagggccguggccuacacccugugugcugcaggu
ccacggccuucauggcagccuuucucuucccauugagacacagaccaccauuggcuacgggucgugugugacug
aagagugcccgguggcugucuucauggugguggcgcagucauugggcugcaucauugacucccuucaugaaugg
ugccaucauggccaagaugcacgacccaagaagcgcgcacagacucugcuuuucagccauaaugccguggugcuc
ugcgugacggcaagcucugccucauguggcgcgugggcaaccugcguaagagucacaucguggaggcccaugugcg
ggccagcucaucaagccacggguccacagaggaggggagguacauccacccuacggaccagauugacaucgaugucggcu
uugacaaggggccuagaccguaucuuccuggauacacccaucaccaucuugcacgagauugaugaggccagcccacug
uuuggcauuagccgucaggaccuugagacagacgacuuugagauuguggucaucuggagggcaugguagaggcca
cagccaugaccacacaggcucgcaguccuaccuggcuaacgagaucucugugggccaccgcuuugagcagugcuc
uucgaagaagaaccaguacaagauugacuauuucacacuuccacaagaccucgaggugccaucuacacccccgcugc
agcgccaaggaccugguggagaacaaguuccuccugcccagcgccaacucuuucugcuaugagaacgagcuggccuu
ccugaucagagaugaggaggacgaggugcuuaccgaccgggaugguccgcaccccucagccccgagcaugacuuugaca
gacugcaggccagcagcgcugcccuugugcggcccuacagacgggagucggagauuugaaugcccuuggcuuagaug
cagcaccaccccugaccacaauaggucccaugcccuuggggggccugcguuugagcagagcaggccgaaagccucggg
ucacagacucaguagcaucuuagucuuuuucauguuuuuucgcuaggggaaauuuggcggggccguggaucug
gcccaaaugacaggcucacggccucggaggcugaugauauacccaugggcaaggaggugacuucuugggguagggu
gcucaggaguuagggacucugcuggaggccuuaggugcaggucccaaccccgguggggaggagcugugguaguguaca
cuucauuggguuuuaacuugggcaagacuguuucaaaccaaacaaacaaacaauc
caaaaaaaaaaaaaaaaaaaaaaaaa 48 AI847051  uuuuuuuuuuuuuguuccuuuuuuggaauucccaaagcugguuuuaauuucaaaaaau
             uaugagguccucuucccacacuggggauaaugggaugggauagcccaaacuauuauccagu
             ucaaccccagccugguccaaacaccauuacugucacugggcccugucauuucacc 49 U09504   uccucguccucgcugcuguuccaucuucuccaaauagcucuaacgugaugccaacggcaau
             cccaagaacgcugauaucucuagcaucgauggugguucugaagagugaccgcacagauugu
             ccugugaaaacaggcaaaaccagugcuccuggcaugacuaaagucacaguggaaugaca
             aaauuuaguggcaugguucuacugucuaaagucugugggauguggcaucaggauccac
             uaguggaguucaugcuuguguaaggcuguaagggguuucuuucggaggagcauucagcaaaac
             auccaguauaagaagugccugaagaaugagaacuguuccaucaugaggaugaacaggaac
             cggugccagcagugccgcuuuaagaagugcugucugggggauguggucuuggcuguguu
             cgauuuggccgaauuccuaagcgugaaaaacagagaaugcuaaauugaaaugcaaagugca
             augaagaccaugaugaacacccaguucaguggccaccugcagaaugacaccuuagcagaa
             cagcaugaucagucagcacuaccagcucaggaacagcugcggcccaagcccagcuggag
             caagaaaacaucaaaaacacuccuucugauuuugcaaaggaggaagugauugguauggug
             accagagcccacaaggauaccuuucuguauaaucaggaacaucgagaaaacucaucugag

TABLE 3-continued

RNA transcripts up-regulated during HF stem cell activation.

SEQ
ID
No: Access. # Sequence

```
              agcaugccaccucagagaggagaacggauucccaggaacauggagcaauauaauuuaaau
              caagaccaucguggcaguggauucacaaccacuucccuguagugagaggcagcaacau
              cucaguggacaguacaaagggaggaacauaaugcauuacccaaacggccaugccguuugu
              auugcaaauggacacuguauggaacuucuccagugcuuauacucaaagagucugugauaga
              auuccaguagguggauguucucagacugagaacagaaauaguuaccugugcaacacugga
              gggaggaugcaucggugugccuaugagcaagucuccauaugguggacccucagaagucu
              ggacaugaaaucugggaagaauuuucaaugaguuuuaccccagcaguaaaagaggugguga
              gaauuugcaaagaggauccuggcuuccgagaucugucucagcaugaucaggucaaucug
              uuaaaagcugggacuuuugagguuuaauggacgauuugcuucauuauuugaugcaaag
              gaacggaccgucaccuuucuaagugguaagaaguacaguguggaugaccugcacucaaug
              ggagcaggggaucugcucagcucuauguuugaguucagugagaagcugaaugccuccag
              cucagugaugaggaaaugagccuuguucacagcaguugucuggauaucugcagaucgaucu
              ggaauugaaaaugucaacucaguggaggcuuugcaggaaacacucauccgugcacuaagg
              accuuaauaaugaaaaaccauccaaaugaggccuccauuuuuacaaaauuacuucuaaag
              uugccagaucuucgaucuuuaaacaacaugcacucgaggaacucuuggccuuuaaaguu
              cauccuuaa 50 U22033     auggcguuacuggaucugugcggugccgcucgggggcagcggcccgagugggcugcccug
              gaugcgggaagcggggucgcucggacccgggacacuacaguuucuccgcgcaagccg
              gagcucgcacuuccccggggaaugcagcccaccgcauucugaggucuuuggugugac
              caggaaaggaauguucaaauugaugcccacggcacaaccacacucgccuucaaguuc
              cagcaugggcgucaucugggcuguggaccuccagggccacugcaggaguuacauuagcucc
              uuaaggaugaacaaagugaucgagaauuaaccccuuaccuggugcaccaugucuggguugu
              gcagcgacucgcagcuacugggagaggcuguuuggccaaggagucaagguaguauauucuu
              cggaaaugggaaccgcaucccgugucugcagcauccaagcugcuuccaacaugaugcug
              caguaccggggggauggccucuccauggccagcaugaucugugcugggacaagaaggga
              ccaggacuuuacuacguagaugacaaugggacucggcucucggggacagauguuuccacu
              ggcagcggaacaccuaugccuacggggugauggacaguggugaccggcaggaccucagu
              ccugaagaggccuacgaccuuggccgcagagcuauugcuugaugcuacccacagagacaac
              uauucggaggagucgucaacaugauaccacaugaaggaagacguugggugaaaguggag
              aguccgaugucgaugaccugcuguacaaguaccgagaggccgcucuguga 51 AF033034   Sequence below.
auuccaggaguuccagcugcuggagaggacuguguagaaggguaaccuaccccaucucucuuacuucgucucuagaugggag
cagacaaguacauauagccugcuuggagcgaggacuuugaaaggcugagacuugcguccacucugagggcaacuaguccaga
cucugacaggucagcauuuccugacuggggcacugaaugccaagcaccagaggucgucaccuuccgacauggaccaaga
gaguccagagaccucaaagacacaggaacagaggguguccuuugggugagagaccugugcccugccaagccucucagcccc
uagaaaggcggcagggcugaguagcugagugugugcaacuugggagcagccugauucagugcuugucaccugugagggca
aaggcagcaugcuuaaugccaucaguccuacucuuucucaccggugaacagacgcauaacugaccuuuuucgugaccacua
uuagggugcauuuaaaaaucucucucuuuucugcucucuuuccaccuuccacaucaugugugugcgugugugu
guguuucugugugugugugcgugcaccauacaggauauaugugccaugacaugucaggucaguagacagccuugguug
ucaguccccugccuucuacuuuguucaaggcagggucuauucuuuauuaugacugcuauccagguacaccaagacaguugg
ccugugagguuccagggagucuccugucucuggccccccaucuuauagcaggaguugugagauuucagaaaugugcacccac
aucuagcuuuauuuggcaucuuggcaccucaaacuugggucaccugcaagcaaggacuucaccugaaccacuucuc
accagcuccacuauggcgguuuucugaaacugaagggagugggagaaggcgcgagugugaacgggucggaaggcgggu
auaaccuuuaaggcuggcugguucugagagaggaaagccggcuugugucccauucaggccaggugcagcaucaaaugug
gcuccacccaacggucaguaauccgcagacagcaccguggguuaacugccucacagaggggggcccagggaccuaguccuua
aagccacuuaguuuugagagacgacauggaggggcaagcccagcccugcucagcugcauucacacagggccccuucuccucc
gaggacccuaccuuugugguuuaguggcugaggcugugguggcucgcuugaagcucuggcuaucaggaaggaccuggcccac
cggcuggcaggacaaacuggcccagugaaggcacuguccggucuccuggguggaucacaaggaaagggcguggcauguccag
auuugaacccuggaugccucucccagggcuaggaagucaagggucaacaugaauaggugaggguggugguggaaagaauc
ugcaugcaaaaucaggcacucaugucugacaucgucaaacacauauuuuaugaugauuuauauggggugagggcuugggga
gcacuuguauuuuugugcaauugcaagagcuuccuccacauugcaguguuaaauaucauuggcugucaguccaucauc
ucuggaacgagggugagggguuugguacccgugacuaugguucucuguguaguagaaacggcuucuugggaagagagagga
agugcuuugaaaugcauccucucuuguuucauucugcaucauggccagguuucugcacaaagaugcaauagacauucag
gaaauaagcgcauugcaagaugucaaaagucaugaaaaaugaaaagcaaggucacugcagcuggggguguaguguggcugua
gaagcacguuuaugaugauacagguucggguccggagagggaggaagagagaggagggaggaauggaggaagagaggguga
gggacaagagaggggggagggagggagaggagaaggggaagaaagagagggagggaagaggaauggag
gaagagagaaagaggggaagaaagagggagggaagagggguggaggaagagaggugagggauggagggacag
agagggagggaaggagaaauggaggaagagagaaacagagagauggaggaagagaaaagucaccaauuauuuucuccccc
agucgccccugcccucacaccaaggguaccccacuuuuucucucacucacacacacaccaaugauuuaggaaca
cauguaggcaggcagagccuuugugaaugugcuuggcuaguuuuucugccuuacuucuaaauaaccaaucacacggaugcca
cagggguuccuuuagacugucggggcucccgggggcucuuuagacuguucccaauggggugucaaugcaaacaguaagcacc
uucuuguuuguggugcccaggaugcugcagguacuagaaauuccugcacagaccuuugcuacuucuacacagacuuacccu
uuaaaacauuuaauuauaauguuuuuuucagcauaaagaucauuuuugugugcgguguagguguguguguguccu
guguguugauugguuaaauugucuguauggggagguguaaugugccuacagaggcaucggaucccccuggagcugccguuacaagua
agggacuggggacucagaccugaguggguuggaugacgcagugaaugagcggugagccauccaccaugcccuauaaacacu
uucaagaggacuuugcggguauggucaagugcccccugcgacagccaccccaacuugccauccucauuuacuguacugg
aagcaacaccucugcaauuugcacaagaaccugagacuggacuucggcugcuuuuguuggccugagccuggucucguucagg
gguggcacauuaaaucuaaaagcuaagaagcucacucaaagcucuugccaaggcaacagcacguuuuggcacaacgguguagc
aggaagggugugugggaauuugaugcuaguuuuuucuuaauuagguugagauguaaaucauggucugguaugcaucccaac
aacuuaauccaaaaaguugguugcacggcuccuggaaggguuuaccggcaaggaaccugucccauuuuguaaguaggguggga
cuggagauuugccaagaagcccccuccccugccccuuccucucuccggcagauucugcuuaaaaugaguguggguucacucgaga
auaguguccaccgucuucagauguucuaaagacauaagaaaggccuagccagcuaaagucagaaaaggggacuuuccggugga
```

TABLE 3-continued

RNA transcripts up-regulated during HF stem cell activation.

SEQ
ID
No:Access. # Sequence augcauuuuccagucucuaggagaagucuuuauccaaauaaaauuagcauagugguggagucacugccagggcgcuggugc
ggaagcacagcccagagccgaggacgugggccauccuccuuccucugaugcaaagguguucucuaucccccaguuaccaugagca
auaucaguagcaucgugaaccgggcccgugaugccuuuaacucaggcaagacucgaccgcugcaguuccggguugagcagcu
ggaggcguugcagcgcaugauc 52 AA960603 uuuuuuuuuccaaaaaauuuuauugggggaaacuacaaaacauuuacaguacaauguuua
cagucacaauuuguagugaacugauuccccaaaauauauuacaacucaaguugacuuaau
cuuguuacauucaaaaaccuacuucugucaaaguaguccagagugcacacgcggugcucc
aacuguaccuacaucaaacuaaacaacugcucauuuaucugccauccaggaaagccgga
gacauuccugccucuuuacauugaaaaauaaauaguacaaguuuuuggacugucauugaac
aaggcauauucaugdaccaccaacauuuc 53 U47737 Sequence below.
ggugauccuccaggaccuaagguuucgguauuaucuucggggccucuucacccggaggugagucugcugagcccgaccuca
ggugucacucgucacgcgagggccuggccacggcgggagcacuggggagagagcgggaggcucuuugaccgcagcguguag
gaucuggggucccggcgcucugcucccgggugcagaguggguuggagcaugcgaggcccucgcagcgugcucugnuccuac
caucacccccaccccacccccagucccuuccugcacguuucuggagaggcaaaggcccucgcugagccuucacuggguaccccua
ucucgacuccacuugucugcuuggaucccaaaggggaucacccucguaaacuagagcaggaggcuggggggugggg
uaggggugagggucugaccaguuagauuggaggcuggaccucccccagagugaggagcgggaagcucuuuugucuuauccagga
uuuugcauaucaaugcugaggguucgggugauuaaguagggugccucugacgcggggguaaccugaacaaccuuccuccgcu
ggccgcuagccaauagacaccuggcuuccgcggaugagcccuuugaguuuguggaggguguucucaggucccagggcccu
gcccccguugccugcagaugugggacagacaaaacauuggacucguuuccaaccacuucaccccuuccuucgcuaguccuc
cggugacgaugggaugccucauugacuuguuuuggcugugcaugccagagcuuucugcagacagcucaggggcuccauc
guuccuaaauccacugguguaacgaaaaaaaaaaaaaacauucccauaucugucacucuccagcagcaaaaacaaacagaaaugagga
caggccagcugggcuuggcacugaacuuggccaccuggagcuuuggcuacccacuacaagaugucagcaagucucaggaua
gaagaggccuaaggccaguccuggaagauaccaaaacuucaccuccucuauaccccguuccucuaggagaacuguaagccacc
uuugucucugggacgccccucuccacuccaacagauggcaccagucaucuuccuccucaagaggccaguggguauucaaauaa
ggauauuggaaaccaagcaagcugguccucuccucuccucuaucugccaaaggucccaaaggcccaaaaggccccacuag
ccaucuggcuggcuagugugcugacugcuacaggugucaguguccccagcgagcagguagugggagguggaggugucuucuu
guggaaaugggguccugagccucuaccuuguacagaaaggaauuaguuaagcccagaggcucccagcccguguucucugccaca
agagagaggggguggggugggggcguguauuuugguucccagggcucagggaagguuuucgguucaugcaugucauuuauc
ugaccacugucuuaaccccaggacaaccacuuaacugccacuuccauaucaggauuccaauucugucuau
ggagcccccugaguuugggaagggguauuaacugaaaggugccauuaugaugaacuuggagaaagauuuguaggugccacggg
agauuucaggauaaaagcucuuuuaauaauuggcuacaauagcagcaggaggaggccaggaauucugaggugagauuugau
uagcagcacguggagcaaaggagacuuucugacuccuacagguuuucagaaaguggggagaggcucucagaugaauggcuugg
acugugaggugauggguuagugugaacacgagacuuuaagcgcuacaaauugcgucugauuuggucauuugggcagcccuu
uagacacuagauaagcaauugggccuuuuaacucgaguugucuuaaauggcuaccccccagggcagcagggagucaauacugcucu
ccugucuggggccugaagcugaaaccaucuacaaaggggacauaaggcauauuggggagguguagagugggccaggccca
ggucugcuggguaucuuaugccaggauccugagugguggugugcguagccuguccuuuuaaccaacugccucucucacaguagg
cuuacuuuggcuugcgaaccuucagcagaugucugccacuuccaacaugagagcuuccugcugugucugnugggcagcccuu
cugggcaugggagcaaggguauggagcucugagauaacccugcagccuggguccuccuccugaucucucauucuuucuccugag
uagaugcccagggcuccucugagccaagccuccuaggaacgucuggccuucccaccuccuacucucuagccaacugaccua
guucccugaugcugugcuggcccagcuacaccuuugucaccucguguugacuuuagccacuccaguaccaaagucugaagu
caguguucauuggcuggcuuuuuuuccugaccccaggggcuggcaugcugguucuugucaguggggugggguucaagg
gccccacuggaaagucaccuuacccuggaaggcuuccccaggcaauaggcagugucaccuacagcauuguccccuuuugcag
uucauuccugaugugcuucucauguaccgaucagaagaacaauauaaacugccuggccaguuucaugccaggagaaaga
ccauuacuguaucacguuaucugccgcugcgggcuugggugaguagcugccuguuucccuagccagggcaggggaccugcg
gggcuuuccccauuuccugcuccccugucugucugucccccucauccucacuuuccaugcagggaugucaaccuuggcuaca
cccugaacaagggcugcucccgaucugcccagugaaaaugucaaucucaaucggugugugcgccgugaacagcacug
cugcaaagcuccuucgcaacuucagcgcagcuggccucgacuucugccaguaucccacuacugggccuuggacuccug
cuuagcuuguuggcucugcugcagcugagcccugaccaucccccaugunuuccauauccccccagcucaggaaaagcc
agcuccuuuuaggucccaggggacccuaggaaccuucagcuccuccggggugugucuaguucccccuccacacucucuaac
gucagggcuaaguaccaaacucaccuauccugcucuguugaagugguaacuggcuaccucggucuuccagagccaaucuaua
accucccuuggggaaccagcgaaggggugaagaucuccuuggagucucaagaguaccagagucagccgccgaaucuuguggac
acacugacaaggaugucuaauccaaauagaugnauaucugugugcucaguguaucccugugugaaugaagccacuuggauu
cuggggugggcaaagaagaccgaaaagauuacagcagaaggccuguguucgccaccaaaacccccuccccccgguaucauu
guacccaccuuguacucuguuucaggaggcugcccauggaggacugccacccccucagaugaaggcucccacuacccgaugca
guugagucccauccugcccucucugccacacuggcuuccugcugcuauucuaguugcucaaauaaaccguucacacccuu 54 L00039 cuuccucccucuacagaagaagagcaagaagaugaggaagaaauugaugugguguggcugug
gagaagaggcaaacccugccaagagguccggagucgggcucauccauuccgaggccac
agcaagccuccgcacagcccacuggguccaagaggugccacgucuccacucaccagcac
aacuacgccgcacccccccccuccacaaggaagacuaucagcugccaagaggcgcaaguug
gacagugggcagggguccugaagcagaucagcaacaaccgcaagugcuccagcccaggucc
ucagacacggaggaaaacgacaagaggcggacacacaacgucuuggaacgucagaggagg
aacgagcugaagcgcagcuuuuugcccgccgugaccagaucccugaauuggaaaacaac
gaaaaggccccccaaggguagugauccucaaaaaaagccaccgccuacauccugccauucaa
gcagcagacacaagcucaccucugaagagcaguuuauuugaggaagacgagaacaguuug
aaacacaaacucgaacagcuugaaaacucugguguauuaaaacugaccucuaacucgaggagga
gcuggaaucucucgugagagcuaaggagaacgguucucugacagaacugaugcgcugg
aauuaaaaugcaugccaaagccuaaccucacaaccuuggcugggggcuuugggacuguaag
cuucagccauaauuuaacugcucaacuaaauaguauaaagaacuuuuuuuaugcuuc
ccacucuuuuuucuuuuuuccuuuuaacagauuuguauuuaauuguuuuuuaaaaaucg TABLE 3-continued RNA transcripts up-regulated during HF stem cell activation.

SEQ
ID
No: Access. # Sequence uuaaaaucuauccaauuuuccauguaaauagggccuugaaauguaaacaacuuuaauaaa
acguuuauaacaguuacaaaagauuuuaagacauguaccauaauuuuuuuu 55 D21099  gugggacgggccccccucgaggucgacccacgcguccgggaguaccccgaccuuggcug
cgugcugacucgcuuccuucugccugcccaggccuugcacucccggggaucugccucugc
aucucuugccuucgcuguugguuucccucucugccagcuccccucccgcucucgcccugg
agaauggcucagaaggagaacgccuacccgugggcccuacggcucaaagacgucucagucu
ggccugaacacguugucccagagaguccuacggaaggagccugccacgacaucugcgcuu
gcucucgugaacuggguccaacagccaguccacagcugcccuggccagaaguuggcugag
aacaagagucagggcuccacugccucgcaaggaucccagaacaagcagccuuucacuauu
gacaacuuugagauugggcguccuuugggcaaaggcaaauuuggaaacguguacuuggcu
cgggagaagaagagccguuucaucguggcacucaagauccucuucaagucucagauugag
aaggaggggguagagcaccagcuucgccgagagaucgaaauccaggcgcaccugaaacau
cccaacauccuucaacucuacaacuacuucuacgaccagcagaggaucuacuuaauccug
gaauacgcccucgcggggaacucuacaaggaacugcagaagagucggaccuucgaugag
cagcggacugccacgaucauggaggaacugucagaugcccugaccuacugccacaagaag
aagguaauucacagagacauaaagccggagaaccugcuguuaggucugcagggagaacug
aagauugcagacuuuggcuggucggugcaugcccauccccugaggaggaagaccaugugc
ggcacgcuggacuauucugcccccagagaugauuggggggcgcaugcauaaaugaaaugguu
gaucuauggugcaucggggugcucugcuaugaacugauggugugggggaacccccccuucgag
agcccuagccacagugagacguaucgucggauuugucaagguggaccugaaguucccccucu
ucugugccuucgggcgcccaggaccucaucuccaagcugcucaaacauaacccccuggcaa
cggcugccccuggcggaggugcagcucacccuuuuggguccgggccaacucaaggagggu
cugccuccccucugcccuuuagccugcuccuugguuuuugcccugucauuuucaguugu
ucuuuguaugucuguguaugugugucugagaaggggguggaacuggaaacuauuccuagc
uccaguucuaggggaucugaucucucuucugaccucuacaggcaaaauuaggcaccccugu
ggugcacauauaugcacgccaaacacaugaaguuacaaacaaacaacaaacacacagaua
gugcuggagagauggcucggcaguuaaaagcacuggcugcucuuccaggaaccuagaac
ucaauucuagcacuacaugguccucacggccacugucguaacacccaguccuggggaau
cuggggccuucgagccucugcaggcacuaggcauggaugugguauacaaugauauggcagca
aaacacccaugcacugacuuuuaagaaacccucuagucugauuccuuucaauuuguucaaa
uguugaauguuauuuuaaaauauuauaagccauuuaauacaauuuuucuuugaaacaug
guauagccuagucugucuuuaaaaucagaaaaauuaugaagaacaacauuuuauaauaaag
ucuuaaauguuuucauguuuuug 56 AF026481 Sequence below.
uugccuaggaagggcgcgucgucucucugcucguccggcugugacggggaagggucccgcugcguuuugucacugugag
uaccaaguuuggggaucccccgagggacucucgagagcucauuuaggaugcagggcuacuccccgguguagagagcu
uucuaguuggcaggaggguucguaugugaggaggccagcuuaggcagaaagcacauguuucagagaugaggacaagacu
aagaccgcuaauucccugaucuuuaccuuccggcccgcugaccugggcccuggaugcuaaaagcccucugcuuucgucuaaaca
gcgcuaaaauaguaaacaguauugccuaagauaaaugcggauuauuacccgauucagugucggaaaaaggcagcuaggagaga
gcggcuggcacguggguaagcacacgguaaguuucgguuaaauuaaaacaaccauccgugagcaucucuuuagcaagcuccuu
ccacccuucaaacaaucagugauaugucgucuguuucacugauuagggagcuaaggcuccaacagcagcaaaaggaacuaauc
cgccucgaucaacauggcguuucuuacagggcauuccuuauacacgcuuuccacgugcguaaggaauucgggguguucccg
ggguuuguuuuguguuguguuuuuugguuuuucuuagugaaagaggcagggugggcuccaggccgcugaggauua
auaaagagauucuaugaggaggaaauaacaggcagguggauaaucgaggcaaggcccgaggaaggcuuggguggggguga
guaaaccagagccggaaguccacucagcagccugggggcacuuaaagcuucgcuggggcaaauguuaaggcggcguaaggu
cacauuccuuucauuucuuccagacucaggaggagaccacacuccggagaaccaggccugaaccggagguacuauuuugua
gcucucagaagccaggacucugcaacacuguuugcugccugugggaucucuauauucacagugcccagguugcuucugauc
uaccacuguagauacuucugccaccccauccuaagaguauaguugucuuuggaaaggagucucagcugcugcucagcaggag
ucccucauucgacuccuguggguugcccuuuccaccaugcaaagaauaaaggcaaagggaggcaaaaacaggcgcagagguaaa
aaugaaaaugaaucugagaaaagagaguugguguuuaaagaggaugggcaggaguaugcucaggugaucaaaaugcuggga
aauggacgguugagcaauggcuuuauacggugugaggaggcguauuagagggaggcugagaaagaagguuugg
auaaauaccucggacauuauauugauuggucuacgagacuauccaagauaacaaagucugauguaaucuuaaagguauaauugcag
augaagcaagaagucugaaggccuauggagaacuuccagaacaugccaaaaaucaaugaaacggacacauuugguccuggggga
ugaugaugaaauccaauuugaugauauuggagaugaugaugaagacauugaugacaucuagccugaccuaagcaugcuacc
uuccaaguucucugaagauagcuccacacaguggcaucuugacccuucacucguuaaaguaaaacuucauucuguguaugc
uuguuaaugcaagcuaaugaauuuauuuuuuugaaguacuauauuuucuuugaaaaccaaaagauguugauuaucaucuuaa
gugacauguuaacacuuugugcuuuugaauauaaauugaaccuagcgcacagcagugagcacuguaagagacugccuuucc
auuugugcuucauuucuggcacgggaguguuugugucagcaguucugccaggugccaucgaugagcugaaguaaguc
cuagccagcacucagccuuucaggcuuuuguaaccucuugaacucuucagcagaacuuuauagaug
uguacggcugcacuuggagucagacaagauauggcuacuuuguacuuaauggagccaugccauuuauacuuucacguugu
auacauucguuugaccccuuaaguguugugccaccccauaaaaaggcaaucuuacagugcaguuuuaaauuacauggguagca
auuuugaguuuaaaaauuagucauugcagaaauuaaauacuuagaggagauaauccauuaucuugauuuuaggaauauaa
uaguugacaauguuauauaauuacuucucuaaaaggcauacccauaacauagcaguacaaggaaaaaagacagugagguuuc
ugaugcuugcauugcauagaagaaguuuuccaacaaagcagcuguuaauaacacauaaaaauauguuuuacuuugcaaaguagg
uuguguuaaagcauuuucaaaaaguuaccuacuauaucgaggcucuggauaauuacuaugugguaugauuaaaguuaguuaca
gaauuguacaagcuaagauuuuccuuaaacuaagcuuagguuaaagggaagagccacagcucaaugaaaacacgguuccug
uuuucuaaauggaggcgcccagaaacacaauaaaacauguuggucaaaaaaaaaaaaaa 57 J04596 caugaucccagccacccgcucgcuucucugugcagcgcugcugcugcuggccaccagccg
ccuggccacaggggcgccuaucgccaugagcugcgcugucagugccugcagaccauggc
ugggauucaccucaagaacauccagagcuugaagguguugcccucagggccccacugcac
ccaaaccgaagucauagccacacucaagaauggucgcgaggcuugccuugacccugaagc TABLE 3-continued RNA transcripts up-regulated during HF stem cell activation.

| SEQ ID No: | Access. # | Sequence |
|---|---|---|
| | | ucccuugguucagaaaauugucccaaaagaugcuaaaaggugucccccaaguaacggagaaa gaagacagacugcucugauggcaccgucuggugaacgcuggcuucugacaacacuauaca auuucuuuugagggguccuauuuauuuaauguauuuauuuauuccacaaagugugugguuu uuauuuuacauuaauauuuaacaguguggauacauuucaucgauggguaguucaguucugc uuguucaguuuaagaugguaggcuuaaaauauuucauuaaaacuaauauuuauugggag accacuaaguguccaaccacugugcuaguagaagggguguugugcgaaaagaagugcagagag auagaguuuaguauuaugucaugcauuagggugaggacauguguggaggcugug uuuguaugucuugaaaagaauguggcaguauuauuggaaagucgucuuucauauuguaug gucaacacgcacguugacgcuucccuuggacauuugugucuaguuggguagcccauaa ugggcuuuuacauucuuuaacccuguuucuccggucucgucucgcucgggacagagacg uucaaaggacuguuacaaaugaaguaaaaauaaaaguuuuauuaag |
| 58 | X81580 | cgucucccgcauucgucugggccgugcaccugcccgcuagcucgcugcacuaccguugcc cacaagccaacaugcugccgagauugggcggccccgcgcugccgcugcccugccgucgu ugcucuugcugcgcucuugggcgcgggcggcugcggccccggggugcgcgccgaggugc uguuccgcugcccacccugcacgcccgaggcucuggccgccuugcgggcccccacccgacg cgcccugcgccgagcugugcgagagcccggcugcggcugcugucccgugugcgcacggc aggagggcgaagcaugcggcgucuacaucccgcgcugcgcccagacgcuacgcugcuauc ccaacccgggcuccgagcugccccugaaggcgcuugucacagggcgcgggauaccaugaaa agagacgcgugggcaccacccacagcagguugcagacagugaugacgaccacucugagg gaggccuggugagaaccacguggaugggaccaugaacaugguugggaggguguagcagug cuggccggaagccccucaagucaggcaugaaggagcuggcuguguuccgggagaagguca augaacagcaccggcagaugggcaagggugccaaaccaccucagucuggaggagcccaaga aguugcgcccgcuccccgccaggaccccuugccagcaggaguuggaccaggucccuggagc ggaucuccaccaugcgccuuccggaugaucgggccccccuggaacaucucuacuccccugc acauccccaacugugacaagcauggccguacaaccuuaagcagugcaagaugucucuga acggacagcgcggggagugcuggugugugaaccccaauaccgggaagcccauccagggag cucccaccauccgggagaccccgagugccaucucuucuacaacgagcagcaggagacug gugggcccaugcccaaagugugcaguaaaccccagccagucggugccuggcuuccccau cccgaacaccagcagaaauggagggcgucagggugacgggguguggaggaguucccaguuu ugacacauguauuuauauuggaaagagaccaacacugagcucagaagccccccucugacc cccccagcgguguuaacugaaccucccuugcuucuguuagagaggggaaggguggugau ggagggcacugggucaggccugggaauggggaagaaauuuuuauuuuugaaucccugu gucucuuuuacuuaagauuaaaggaaggaaaaauaaaaaaaaaaaaaaa |
| 59 | AI314958 | gaugugaaaaacguuuuuauuauaaucucuaaaacuuucaguguauauuuucauuacaau cauuggucaauaaauauggaaaugcugagcagacaauuaucaguggccuaugggcug agggacagggaccaggaauacuguuacccuggauacuccucagggccaaucaggaggu cuucaaagaguauugagagggagagggauagaaauauuauuaagacugucagugcagcaa cuuuuagaaugucuauuaaagccauggaacaggauuuacgauaacagaagaugauacu aaaaaagaacagagacucaaguucuccuguaagaggcagaagaaacauugcagaagccag ugccuuccucgggucccagugugugcccccauccaccacgcauugugguggucaucuc caccugcccugugcccagcccugugcccaccagguucuccuaggcacccaccuugcacc ucgcacg |
| 60 | AF058798 | gaauucugcgcgguuuugcauuuuuugggucagauuggcuuuuuacaugauuacgaagc uccaacgacuagaccacagggaccgucgccuuggcggccgagcagucguauccaacuugga gacagccaguucgccgugugucugucuguccuucaucgcagucauggagagagcagucu gauccagaaggccaaguuggcugaacaggccgaacgguaugaagacauggcagcuuuucau gaagagcgccguggaaaagggcgaggagcucuccugcgaggagcgaaaccugcuuuccgu agccuacaagaacguggugggcggccagagagcggccuggagggguccuguccagcaucga gcagaagagcaacgaggaggggucagaagagaagggccccgaggugaaagaguaccggga gaagguagagaccgagcucagagggugugugcgacaccguacucggccugcugcugcca ccucaucaaaggggcuggagaugcagagagccgcgucuucuaccugaagaugaagggguga cuacuaccgcuaccuagccgagguggccacuggcgaugacaagaagcgcaucaucgauuc ugcccggcucagccuaccaggaggccauggacaucagcaagaaggagaugccgccuaccaa ccccaucccgccugggccuggccccugaacuuuucaguccuuccacuacgagauagccaacag ccccgaggaggccaucucgcuggccaagaccaccuucgacgaggccauggccgaccuga cacccucagugaggacuccuacaaggacagcacccucaucaugcagcuccugagagacaa ccugacgcugggacagccgacagucugggggaagaggguggaggucccggaugaccc ccacaucugaagcagcggaaaaacaacccggguuggcuuggccuuccaguccccagccug gcauagaggauuaaaaggggagugggauuuugccuuucccaaacccugaauguucagcaac accuuggaagguucuucgaaggggcgcaggccaagcugaagccaccagggcagggaauu uaauuuucguguagcuguuuggguggguguuucccaaaaccauccccacccccuguuuuuu gaacccccuccccaauucuuccccugagcccuccucgggcaccuguugcuuuuggaucc gaauaauccaggaggguucccacccuggggcugaaauggacuguggcaagggcugugu gugugugagagagagggaaacucugugugugugugugagagagagagagagagugaa ugagagggaaaaaguuugggguggaccauggguacaaucaauaaaaguugcccugug gacucaaaaaaaaaaaaaaaaaaaaaaaaaaaaaaaaaaaaaaaaaaaaaaa |
| 61 | AW046627 | uuuuuuuuuuuuuuuaaauaccaaaacauuuaauugaaauaccuguauaaaaauaug aucuucagacauuucacauuuugaacuuauacaaccccaccccugaugcuuagucacac cagggucacagaaacacagcugcuaaaauaaauuaagggcuugagagacucugucccccaac |

TABLE 3-continued

RNA transcripts up-regulated during HF stem cell activation.

SEQ
ID
No:Access. # Sequence cccagcuuucagagccagcaagcagacuguacaaggucaauaauuuaaaccccuccccag
cgcagagugcucagggugacagggucuc 62 AI848050 uuuuuuuuuuuuuuuuaauguaacgaccggugugcuucaguuuguuuagcagaaccac
ucucuugaaucacauuaacuuuugagauuuaaaaaaaacaaaacaaaaaaaaaaaaaaaaca
acaaaaaaaaaaccaacccuccauagcacagcugucuuuuaugcaagcaagagcacaccu
acuccagcaugauuuugucaucuaaagacuugaaaacaaaacaacaacaacaaaaaguuac
uuuauagucaauggauaagcagagguccgaauuuacacuaaaucaagacagaccuucgagggg
ucacgauaaguccggaacuuucaaaccuugcuucguaugaauuguacuaucugaacauaa
acugcacuuuuauuuuc 63 AF065441 augagacuccacagccucauccugcucuccuuccuucuccuggcuacucaggcguucuca
gaaaaggucagaaagagagccaagaacgcaccacacagcacagcggaggagggguagag
gguucagcucccucguuagggaaggcccagaauaagcagagaagcaggacaucuaaaucu
cugacgcauggcaaguuugucaccaaagaccaagccacaugcagauggcgugugacugag
gaggagcagggcaucagccugaagguccagugcacacaagccgaucaggaguuuucuugu
guuuuugcuggugacccaacugacugccuuaaacacgacaaagaccagaucuacuggaaa
cagguugcccgcacgcugcgcaaacagaaaaauaucugcaggaacgccaagagugucuug
aagaccagaguguggcagaaagagauuucccagagucuaaccucaagcuggugaacccaac
gcacguggaaacacgaagcccaggaaggagaaagcagagguucuccgcaagggagcacaac
aaggccaagaagcugucuccacggagccaaacaggguuagaagacaucacacucaau
ccagcugcgacccagaccauggccauuagagauccagagugucuagaggauccagaugug
cucaaccagaggaagaccgcccuggaguucugugggaaucuuggagcuccauuugcaca
uucuuccucaacauguuacaggcgacaucaugcuaa 64 AF022992 Sequence below
cgggucgacccacgcguccgcccacgcguccggcggagcuucgggguugcgggccgaaacggcaagcggauggagggcgcuc
gaacggcagguguegugauuaaauuagucagccucagagacaggucgccuaccuccuuuaauccagaccucaaaagcccg
uugugcacccgguggugcuucuucaccuucccuguuucguccuccacuguauggccagacaugagugguccccuagaagg
ggccgauggggggaggagaccccaggcccggagaaccuuuugccuggaggaguccauccccugggcccccgcagcaccgg
ccuugucccaggcccagccuggcugaugacacugaugcaaacagcaauggcucaaguggcaaugaguccaacggacccgagu
ccaggggcgcaucucagccggaguucucauagucucuucugcaggccaauggcaagcacucagcucugcagcacugagga
cagcaagaguacaaacucacagagcccaucccccacccagcagcccauugccuacagcgccuccugagugcgagcucagagcagg
acaacccaucuaccaguggcugcagcagugaacagucagcucgagccaggacccagaaagaacucaugacugcacuucgggag
cucaaacuucgacugccaccagagcgucggggcaagggccgcucugggaccuugccacacugcaguacgcucuggccugug
ucaagcagguucaggcuaaccaggaauauuuaccagcagugagucuuggaggguugaggucaggcauggcauggacagugcua
cuuacacccuggaggaauuggagcauaucacauccgaauacacacuucgaaaccaggacaccuucucugguggcugugucccuu
ccugacaggccggauugucuauauuucggagcaggcaggugccugcugcguugcaaacgggaugugguuucggggugcccg
cuucucagagcuccuggcuccccaggaugggguucuucuauggcucuacuacaccaucucgacugccaccugggggcacu
ggcaccucugcagguucagguucaaggacuucaccccaggaaaagugcuuucugccaagucuccuggaccacugagaccggg
auccaggggccucgguaccagccauuccgccuaaccccauaugugaccaagauucggggucucagauggagccccugcacagcc
gugcugccuacucauugccgagcgcauccacucugguuaugaagcuccccggaucccuccugacaagaggaucuucaccacc
cgacacacaccaagcugccucuccaggauguagaugaaagggcugccccacugcuggguuaccuucccaggaucuccugg
gggcucaguacuucucuuuucuacaucaucugaggaccgaccccucaucauuaaagaagaauacagcagcuggcagg
ccagcccuuugaccauuccccuauucgcuucugugcucggaacggggaauaugucaccauggacaccagcuggggccgguuu
ugugcacccccuggagccgcaaggugcauucgguguugggucgccauaaagugcgcacggcacccugaaugaggacgucuu
cacuccccagccccagcccagcuccgucccuggacucugauauccaggagcucucagagcagauccaucgauugcugcugc
agccugugcacagcucccagccccacggggcucugggaguuggccucgggauguccuggccucuuacacagcccuggcuc
cucagugauagcaaugggggggacgcugagggggccugggccuccugcuccagugacuuuccagcagaucaguaaggaugu
gcaucgguaaagcaccagggacaacagcucuucauuggaaucucgggccaagccccccaccccggcccccgccuccuugcuacag
guacauucaaagccaaaguccuucccugccagucccccaaaccccgaacuggaggugccccaguuccugaccaagccucguua
gccuuggccccugaggagccagagaggaaagaaaccucuggcuguuccuaccagcagaucaacugccuggacagcauccuca
gguauuuggagagcugcaacauucccaguacaacccaagcguaaacaggccuccucccucuacacacugccucuucagccuc
ugaugaugacaagcagaggggcagguccaguucugugggggccaagaaagauccgucugcaauggcugucuggggaggg
ggcaacuccucggaaggagccaguggguggagccaccccugagcccgcucgcccuggccaauaagcagagagcguggugucc
gucaccagucaguguagcuucagcuccaccaucguccauguggggagacaagaagcccccggagucggacaucaucauggaugg
aagaccugccuggccuggccccuggcccagccccagcccucaguagcccccugaccccaaacccagaugcu
uaucgcccagugggucugaccaaggccgugcugcugucccugcacacacagaaggaagagcaagccuucucaaccgcuucagag
aucuuggcaggcuucguggacuugacaccucuucuguggccccucagcccuggcugccaccauggccccauuccccugg
ucgccgacaccacugccgaucaaagcaaagcguuccgccaccaccaccaccagaccccccggcccgaaacucccugcuaugu
cucccaucuucaccugugcccuucuggaccccuuccaccgacgcacccuuuccccagcaauggucccagcccu
acccacuccagauuucuccccucgaggaggaccccagcccccuuccccugcccuacaucuguguccccugcuaccuucccu
ucucccuuaguaccccaauggugggccuuggugcuccuaacuaucuauuccuaccccaccuaguuauccauaugggugu
cccaggccccuguuaggggccacccacgccugcuuccacucgcccucuccauccugccccaccaccucucagccccccc
accgccagacucccacuguucaacugagaugcagcuccccacucagcucaauucugcuuagaggaguucagugccccccgc
acggaggggggcgcugcugcaggaggccaggaagcagugcugggccccugccuccagugaggagacugcugagccagagg
ccagauuggggugagguuacugagucguccaaucaggaugcacuuucaggcucagcgaccugcuggagcuacugcuccaaga
agacucucgcucgggcacaggcuccgcagccucaggcucccgggcucuggccuggggucuggguucaggauccca
cgaaggggggaagcaccuucagccagcaucacccgcagcagucagagcagcaagaaguacuuuuggcagcaucgcacucuu
ccgagggcugaacggggccugcucggggcaggacuggccuggugaccaggucauuaaggugugugcuccaggacccccaucu
ggcugcucaugggccaaugccgaccagcgugucaugaugacauaccaggugccguccaggaugcagcucugugcugaagca
agaccggagaggcuccgggccaugcagaaacagcagccacgguucagaggaccagaggcgggaacugggugcugugcac
uccgggguccggaagggccagcugccucgggcccuugaugugauggcgugugggacuguggcagcagcguucaagauccu
ggccacucugaugacccgcucuucucagaacuggauggauugggcuggagcccauggaagaggguggaggcgagggugg

TABLE 3-continued

RNA transcripts up-regulated during HF stem cell activation.

SEQ
ID
No:Access. # Sequence gggugugguguuggcgguggugggggugaugguggugaggaggcccagacccaaauuggggcuaagggguucaagcucuca
ggacucugccauggaggaagaagagcaaggugggggcucauccagcccagcuuuaccugcagaagaaaacagccaccagcuag
auccauuuuggggccgcuuacagcagucuaaugagaggcuuccuuucgaccaugauuggggguucuuauaacucaagauacag
cuggaccaaccaauaggaaacugccccagcuucuccccaacauaggggggcuggacccccauuaccagcccaggcacaggagcug
ccucuagcuucuuagcagaguggaaguucucagcccauuuggaggaaugagugccacgcccgucccacugaggagacgggcgg
gucuucgguuaagguugcugacaagcugcugaaguggucuguccaaaucccagcugagccugagucccagucgcaggguug
gggcugcacuuauuuauuugggagagacagcucacucucccaccucacccccaagaugggaggagggggaaccugggaucugu
guaggauccaggguccgugaaccccuagcugcuccaggguggggaggauuggguggaccauggagucccuggugcugcccccc
aggugggacccaggaguguucucagcucuaccccuaccaaugacauuuguguuuuugauauugugucuguuauuuuuuuuu
uaauacaaaaugacaaaaugaaaaaccaaaaa 65  AF064088  Sequence below.
gacagcggagcgcgguggcgucgacgucuagugucucagugucccgucuguggcuaacuaagcagccagcagccaggcagc
ucgcgaccugcggccaggcagccaaccaugcucaacuucggcgcuucucuccagcaagcuucggaggggaaaauggaacuaa
uuucugaaaagcccagagagggggaugcaucccugggacaaagcugagcagaguugaacuuugaagcggugggaagcgcucauguc
caugagcugcgacuggaagucucauuucaagaaauaccuugaaaacaggccugcacaccagugucugauaccuccgaggau
gacagcuugcuuccagggacgccugaccuucagacaguccccagcauuuuguuuaacgccaccuuacagcccucugacuucg
aacccucccaagggucaaaucugacugcaucagcgccaucuacuggccacuucaaaucuuuucuccgaugcugccaagccucca
ggcgccacucccuuucaaagaggaggaaaagaaaucuuuagcugccccuccucuuccuaaggcucaagccaccaguguccauc
gucacacagcugaugccccaacugugcaaccaccagucucugccccgugaaagcagcuagccucuacaacuauccaggacaauucu
uuccggagaagaacccacggaaaguugaggcuacucgaaagaacauacccugugcugcagugucaccaaacagauccaagcc
ugagcccagcacagugccgaaugugaugagaagggcgggcgcugcacuauaugacuuugcugugccuuccucagagacagu
aaauuuguagcgucugcagccagucucuccguccccagugcagaagcaguacuggugucuuccucuacaguauccacuggggg
agugccaccccugccugucaucugccagaugguuccccuuccugccaacaacucucuguuguuagcacaguuguccccagcacu
ccuccuagccagccaccagcugucugcucaccugguuguucaugggcacucaggugccugagggcaccgucuguuugug
guaccccagcccguugugcagagcccaaggccuccaguggugagcccaguggcaccagacugucucccauugcccugcuc
cuggauucucuccuucagcagcaagggucacuccucagauugacucguccagaguaagaagucacaucuguagccacccagg
gugugggcaagacuuacuuuaaaaguuccaucugaaggcccacgugaggacacacaggugaaaaaccuuucagcugcagc
uggaaggcugugaaaggaggguuugcucgcuccgaugaaccuguccagacaccggcggacacacacaggugagaagaaguuug
ccuguccaugugugaccgucgguuuaugaggagcgaccauuuaaccaagcaugcccgacgccaccuaucagccaagaagcu
gccaaacuggcaaauggaaguuagcaaguuaaaugacauugcucugccuccgacccugcuuccgcacagugacggccagaa
gauggagacgcagaauaaacuuuggucagagucaggagccagaugugguuucucaaggcuuuggcccucca
aaagggccuaaaguagaagcccuggccuggggaggccccgccuggguagaaugacaagaagugcuucagccacaggcaggu
cacagaggcagggcucaguucuuaccacagagagagaggagaacccuuuuauuccuccccuuauuuuagucuggaaaguuuc
ggcugaggugagcgcagcacagguuuugaaucacauacacauugggacuuuguuuugccauuauacuugagaccagcu
uugcaguguaauucuuucaaaggaauuggucaagcagagccuagaauauaagggcuagaacagaaauggagcuagaaaug
aguuugguguuacacagagaugucaucuucuccuagaguuaucuuguuucuuauucuaguucuuccagucaaauccgugga
uguagcuaaguauaucuaaaacucauuuuuccacuauuguuguauuugaaguugaacagcuguacauugcuguggggag
ccaaaggauuggaacccucauuaauuaauugcuuggaaaugcagcuaaaauucuucuuuggcauuuuguuuugaaaguuu
aggcauuuuacucuacuuuuagauuuuuagucuggcaguuuuuugguagauuuguagaccaauguguuuuuc
uguaggcuuaaaauacacugcacuuuguuuagaaaaaaaucuggagaugaaauaugauauuauaaagaagagaugucaagaa
uuugagauaaccuccuugagaaaguuggcuuuaugucaucagcaaaggacacuuaacgucaagcauacacuguggguuuuuu
guuuuuuuguuuuuuuuuucaaauugaaaguuuaaugaccguuacagauggacagugucuuuuauuuauaggaguuu
uucaggagugcagaguagauagguaagggaaaauguuaauuagaacaugcaaaaaggaauuuaaauggugguca
uguucuuagcaccacagugucugggcaucuggggaaacuccgagacuuuuuuaaagugucaugaugugaucacaccgcagu
uugggggcaucgaauccagggccuugcaugucuucguaagagcucucaucgcugaccuguauccccgcaagagcaaugacu
uuugcuaacaguauuucuuuucuguuguaaagguggacagaugauacacuuggucgcaaaggaaauuauucaaaauccaca
gugaaaaccucaccacacuuucccauuuaaacuauuuccauaucucagagguuuucugacaugcaaacuugaacccuugaaag
aagaguuuucuuaaaaauuauaaaaaaucacgaguucaauuugcacaauauuuuuguugaacuuuauaccuuguuuaca
auaaagacuuuucuuug 66  AI787713  uugucanuugcacgacagaaacugcaggaagaugagaugcgccgggcugcggaggagcgc
aggagggguaaaaggcugaagaguuagcugccagacaaagggucuagaaaaauugaaagg
gacaaagcagagagagccaagaaguaugguguagugugggguucucggucauccccacca
gcaacagacccaggguccuguuccuucuucuccccagccaggagccccuacuaagcgggag
uaugaccagugucguauacagguuaggcugccugaugggacuucacugacccagacuuuc
cgggcccgggaacagcuggcagcugaggcucuacguggacguucaccguggggaggag
ccuggacaggaccaggaccccugucaguggcucaguggcuuccccagacgggcuuucuca
gaggcugauauggaacggccucucgcaggaacugggacucgugccuucugcuguccucauu
guggccaagaagugcccagcugaggguucuccaucccaccaucuc 67  AI853531  uuuuuuuuuuuuuuuucacaaauaaguaauauaacuuuauuaaaaugaaaagacaauau
ucaaaauaaugcaacaaaaugaauaaaauccuuugucccaauacuguacacacagugcggag
aucagugcauuuuucuaaagcaugguuuuaaccuucauuuaguucauacuaaaguaagcuu
uaaauagcucaaauaaugucauucagcaguuuaaaacugaacacgacuugguugggacauggca
gcaguguccccugcuagcaagcaccuucucuuuguguuuaucugcacaagauaaacaauca
gaggaugugaaaaacugaacacaaacugcgugucucacugaaucucagggcagugaagcag
ccagcgugaguuucaaagcaggaagaugcugaagugaccucuggcauuaagacguucug
ugcua 68  X14678  Sequence below.
uucauuggaaagcacauugcucuucucaguaauuucuuuaguaucuucaugaauuuuuccuuuugcgucguuauuucag
caauucuacucugcagaucauaaagguaguauuugacagaugugauucuuuuucuuaaacauuucauuuccaggguaaggaac
ucaauggcuauguuuuucucuccccucuaguggcaucccuucuccuuuuucuaccauuuucacucuauuuaacuucaucauguuc

TABLE 3-continued

RNA transcripts up-regulated during HF stem cell activation.

| SEQ ID No: | Access. # | Sequence |
|---|---|---|
| | | agucuggccuuuggguuucaucauagcaaucuguucaacuucacccugcaagauuaaaaaucgauuauggucuaagucaau<br>gccauggcuucuaaggagauuuccaacaucuuuuaaacgucuucuucuuccacuuaugugguagacagaagugcuaucucu<br>guaggcgguucuggauacauagaaguugcguuuaggaaggacuucguaaucaucuccuuccuuaucaauuaucuuuugaaa<br>augaacuucuacaguacaacucugaauauccuugugguucaucagaauuauguaucaguaccgauagcuuuuuuagaccuuau<br>uuuuugugcucgauagccaaacacaaaaagcauggaaucaauaacauuggauuuuccacugccauuuggucccaauaauacag<br>gaaaagcgcuuauggaaaggucccacaaguuucucuccagcauaggacuugaaguuuuugguuuacaauaugaguuaucaug<br>agacgaggagcuccagcuucacuggccauggcuggaggugggggguggagggauacuauucaaaaucuccucuaaacuucug<br>uuauccagcuccucaccuggaggcuuugcggggugcagcgcucccucaccuacuucgccuacugcaacucccaccaccuccu<br>cucgauacaagaccgagcucgucggaccuacucagaaagcgggcguugucgcuacggggccaagugccaguuugcucacgg<br>ccugggugaacuucgccaagccaaucgccaccccaaguacaaaacggaacucugccacaaguuucuaccuccagggccgcugcc<br>ccuauggcucucgaugccacuucauccacaacccaccgaggaccuagcucuccuggccagccccaugugcugcgacaaagc<br>aucagcuucuccggcuugcucucaggccgcagaagcucgccgccaccuccaggcuuuucuggcccuucccugucucuuguuc<br>cuuuucgccuuccagcuccccaccgccccuggggaucuuccacuuuccccuucugccuucucugcugcccucgggaccccu<br>gugacucgaagagacccuaaccaggccuguugcccccuccugccaaggucuacuaccccagcaccaucggggggcccuugg<br>guggccuggcucggagccacucgcccacucucugggauccgauccuguaacgcacgcagcggcagcagcugggggg<br>gucagacucaccugucuuugaggcaggggguguuugggcucuccccagacccccugcaccccaaggcgucucccaucuucaau<br>cguaucucugucucugagugacaagugccuacucuacccaguauggaucagcuagaucucaaagagagggcagggacugcuca<br>uugcugggggaccuggggcacuccucuaaguuuaauaaguccaucuucuggacauuccaagaugcaauaacccauuuccccuu<br>gggucugggcugggggcagguccucuaguuugcaaauucaguguuuuggguggaaccugauccuaggguaccuaagauguuuga<br>gggagacaguugacaguuggcuuucaggccccaagucuucuguguuuuugagauaggagcuuauuauggguaccccaggc<br>uggcuuugaacucaauauaauccugccuuagccuuuuccaaguucuggggguuacaggguaugcaccagcccccucugcaacucu<br>ggucuccuggaaucuuaagugcugugaagagccggcucccacaauacuauccuaauuuuuacuagaccccugaaguucagug<br>uccgguggucgaagccucuccugagaauccuggugcucaaaauuccccuccuaaagcaaauagccaaagccaaaugccaaauc<br>cuucucccccaaccaguggggccccuuuauuuaugacgacuuuauuuauugauuuuagauuuauaguauuuauauauauaugg<br>gucgcucacuccguuuuucuuuuuguaaguuaaaacugauacuguauuaaguauaugcuauaauauauuaaauauauugcu |
| 69 | AI854358 | cggacgcugcagaccugaccgacgugcugugcgaguucgacgcggugcuggccgacuucg<br>cgucgcccuuccacgagcgcacuuccacuaugaggagcaccuagagcgcaugaagcggcg<br>cagcagcgccagcgucagcgacagcagcggcuucagcgacucggagagugcagacucagu<br>guacagggacagcuucaccuucagugaugagaagcugaauucuccaaccaacuccucuccc<br>agcucuccugcccuccgcugucacacucucggaaagccaaauuaggugacacuaaagagcu<br>cgaagacuucauugccgaucuggacaggaccuuagcauguaugugaagcaaggaguuuggu<br>gguc |
| 70 | X67668 | ccggccgaggagaagucugcaaaacaagaggcugggggauugccuuagcgagaaaucagu<br>ucucuuaggagguuaggguaggaaggaagucuuucucuggaggucuggaggagcgcucguguc<br>agaugccgggguugucaugggguaagggugaccccaucaagccgcuggggcaaaauguccucu<br>uacgccuuuuuugugcagaccugccgggaggagcacaagaagaagcaucccaauucgucg<br>gucaacuucgccgagaucuccaagaaaugcuccaagagauggaagaccaugucugcaaag<br>gaaaacucgaaguuugaagauuuggccaagagcgacaaagucuuguuauuacagggagaug<br>aagaacuauguuuucucccaaggugauaagaaaggaaagaaaaaagauccaaaugcuccg<br>aagagaccaccgucugccuucugccuguuuugcucugaaaaucgcccaaagaucaaaauu<br>gaauacccgggccugucuauuggagauacugcgaagaaacugggugagaugugguucugag<br>cagucugccaaagagaaacaaccguaugagcagaaagcagcuaaaacuaaaggagaaguau<br>gaaaaggauuuugcugcauaccgugucaaagggcaaaaguggaagcaggaaagaagggucu<br>gguaggccagcaggcucaaagaagaaugacucaagaaugaggaagaagaagaggaggaa<br>gaugaagagggggaagaagaggaugaagaauaaguggcuauccaaaguguggaguauau<br>gugcucaggcaguuauuuugcuaagaaugaaauucaagcgcagcucaacauuagcucca<br>guaggaa |
| 71 | K02236 | aucacgcuccuagaacucuucaaaccgaucucucgucgaucuucaa<br>ccgccgccuccacucgccauggaccccaacugcuccugugccuccgguaagggggacugc<br>ugacgggauuucugggagagcuagacaggcuuuuuggcccccucuuuaguaauuacuuua<br>aggguacgaccggcuaccccuuccgaaugaauucugaagcacuccugucccuuuaaacua<br>guccuugagauaguggcucgccuacccggguguuugccucaccuuccuaggagaacagc<br>guucaagguacucccggguccccacucaaccgcgcucacugacugccuucuacuuuuagaug<br>gauccugccccugcgcuggcgccugcaaaugcaaacaaugcaaauguacuuccugcaaga<br>aaaguaaguuggaucuucucugccauuucccgucacucuccuggggucccuagcccgcc<br>gcgccgcgccuucccuccgggagcguucaggugggugugccucugacaagguuucucgcu<br>cacguucaacucuucucuccccacaggcugcugcuccugcugccccgugggcugugcgaa<br>gugcuccagggcugcaucugcaaagaggcuuccgacaagcagcugcugugccugaag<br>ggggcggagggguccccacaucugguaaauagaccauguagaagccuagccuuuuug<br>uacaacccugacucguucuccauaacuuuuucuauaaagcauguaacugacaauaaaagc<br>cguugacuugauu |
| 72 | X51829 | Sequence below.<br>gcucugaguuugugaagauuacaugcgauauccgcgcgaccccgcaucccuuugccgccgggacagccuuugcuacagc<br>cuguaaacauugcgucccgagccccacgccugagggcgacaugaacccgcuggcuucgcgagcagucggacccacgauc<br>gcuuuuugcaaccagaaccggcgcuucagccccggggugacgccgcccgcccagacacauggccgcagccccaagac<br>cccagcauguccugcacugaggggacgcccacaacuucuauccccugcucacugaugggcuugcucagucggccuggag<br>ccgccugagggggccagaagucccagaggcauggcuggcaaaaacaguaacaggagcagaucagauagaagcugcggcucug<br>cugacaccuaccccugucucugguaaccuccuccccucauggggagacugaagaaaguggaucuccugaacagagucaagcag<br>cccagaggcucugccuuguggaagcugaaaguucccccuccugaaacuuggggacuuucaaaguuugaugaguacaaugcaaa<br>gccaggacaagaugaccuuagagagaaggaaauggaacgcacagcuggcaaggccacacuacagcccgcuggccugcaagggg |

TABLE 3-continued

RNA transcripts up-regulated during HF stem cell activation.

SEQ
ID
No:Access. # Sequence cugauaagaggcuuggggaggugguggcuagagaagagggaguggcugagcccgcuuaucccacaucacagcuggagggug
guccagcugagaaugaagaggauggagaaacagugaagacuuaccaagcuucugcugcuuccauagcuccgggauacaaacc
cagcaccccugugccuuucuugggggaggcagaacaucaagccacggaagaaaaaggaacagaaaacaaggcugaccccucca
acucuccuucuucaggcucccacuccagagccugggaguacuacucuagagagaagccuaagcaggagggagaagccaaggu
agaggcacacagggcagggcagggucaccuugucggaaugcugaggcugaggaaggaggaccugagacaacuuuugucug
uacuggaaaugccuuccugaaggccuggguguaucgcccaggagaggacacagaggaagaagacaacagcgauucggauuca
gcugaggaagacacagcucagaccggugccaccccccauacaaguµgccuuccugaaggccuggguguaucgcccaggagagg
acacagaggaagaagacagcgauucggauucagcugaggaagacacagcucagaccggugccaccccccauacaaguygccuuc
cugaaggccuggguguaucgcccaggagaggacacagaggaagaaaacagcgauuuggauucagcugaggaagcacagcuc
agaccggugccaccccccauacaaguygccuuccugaaggccuggguguaucgcccaggagaggacacagaggaagaaaacagc
gauuuggauucagcugaggaagacacagcucagaccggugccaccacauacaaguccuuccugaaggccuggguguauc
gcccaggagaggacacagaagaugacacagaagaggaagaggacaguugagaaugugccccaggugacucagaaacagcugac
ucaagcagagucccugccuucagcccagcguugucuaccaggagagaagaccaagggacguggggaagagcccccucucu
uccagguggccuucuauuuacccgagagaagccagaaucaccuugggcugcaccuaagcugccccuucgacugcagaggcg
gcucagauuguucaaaagcccacccgggaucaggaccccgagaaucucuaaaagucggaagguacacuucgcugagaaa
gucagguccauuccuugcugucugggcaggaccagcccaagcugcccgucgaggucccuggggagcaguuucacgaggauc
gaagccgcuuugcucgacgcauugcccaggcagaggagaagcugggucccuaccuuaccccugauuccagggccagagcaug
ggcacgccuuagaaacccaucucuuccacaguccgagccucgcucuuccucugaggccacucccuugacccaagaugugacca
caccucucccccuucccagugaaacccuucgccagccuguacuugggaggggaggcggggcuaagccugaguaguuuccua
uuauuuauuuauuuauuuauuuugaauaagaaauaaagccuuuuaauuugaguguau 73 AW048937   uuuuuuuuuuuuuuuuuaaucaucgagaaguauuuauugagcaccagcuuuggggucgg
             gugugaggacucgggacaaugcagggugcugucccuucucgugagacgcuuacaaucuga
             gugagacagggagggagccacaauacaguucuuggggugcgggcuaagggguagacagu
             ccagaccaggauguuacagaaacagggauguuugggggcuggagucagacccacuaagugcu
             uugacacccacgguauucaacacugagaaaggaucagccauugcucagugccuugugagc
             ucccuuagcccccaagacaccaucuuggccuggcuccuuguacaacugcuacuaa 74 AV139913   cccaaaacccauucagcaaaguucccaaccucgacgggcuagcaguauuuaaccagugau
             gggucacugguguauuuggugaauacguauuuuguucaguucuuucucccagauaa
             uuugaaaacguuccaggagaaggcagcuuccuauaugcagcgugugcuuucuuauucuuu
             uuuuaauauaugacaguuauuugagaacccauuucuacuuugaauucauuuucguugaa
             agugauguuucuucaccuaccauuuuccuauuaaaguucuguauucaaau 75 M32490    Sequence below.
agaccgugagcgagagcgccccagagaagcgccugcaaucucugcgccuccuccgccagcaccucgagagaaggacacccgcc
gccucggcccucgccucaccgcacuccgggcgcauuugaucccgcugcucgccggcuuguuggucugugucgccgcgcuc
gccccggguuccuccugcgccgccacaaugagcuccagcaccuucaggacgcucgcugucgccgucaccuuccacuugacca
gacuggcgcucuccaccugccccgccgccugccacugcccucggaggcacccaagugcgccccgggagucggguuggucgg
ggacggcugccggcugcuguaaggucgcgcuaaacaacucaacgagcugcaguacagccccugcgaccaccaccaagg
gguuggaaugcaauuucggcgccagcuccaccgcucugaaagggaucugcagagcucagucagaaggcagaccugugaauua
uaacuccagaaucuaccaaaacggggaaagcuuccagcccaacuguaaacaccagugcacaugauuugauggcgccguggc
ugcauuccucugugucccaagaacugucucucccaauucugggcugucccaaccccggcugguggaaagucagcggggcagu
gcugugaagaguggguuugugaugaagacagcauuaaggacuccccuggaccgaccaggaacucccucggacucgaugcu
cggaggguggaguuaacgagaaacaaugaguuaaucgcaauuggaaaaggcagcucacugaagaggccuuccugucuuuggcac
cgaaccgcgaguucuuucaacccucugcacgcccauggccagaaaugcaucguucagaccacgucuuggucccagugcucc
aagagcugcggaacuggcaucuccacacgaguuaccaaugacaacccagagugccgccuggugaaagagacccggaucugug
aagugcguccuugggacaaccagugacagcagccuaaaaaagggcaagaaaugcagcaagaccaagaaaaucccagaacca
gucagauuuacuuagcaggaugcuccagugucaagaaauaccggcccaaauacugcggcuccugcguagauggccggugcu
gcacaccucugcagaccagaacugucaagaugcgguuccgaugcgaaaugagagauguuuccaagaaugucaugaugau
ccaguccugcaaauguaacuacaacugcccgcaucccaacgaggcaucguuccgacuguacagccuauucaaugacauccaca
aguucagggacuaagugccuccaggguuucuagugugggcuggacagaggagaagcgcaagcaucauggagacgugggugg
gcggaggaugaaugggccuugucacuuugaguagcauuagguauuucaaaacgccaagggcaugagggugacggac
agcagcgcagccgcaguugagaaugccaaggggcugaugguggacggacagcagcgcagccgcaguuggagaagacuucgcu
ucauagcuacuggagcgggcauuauugcuccauauuggagcauguuuacggaugacguucuguuuucuguuuguaaauuau
uugcuaagucguauuuuuuugcuccagacccccccccuuucuuggguucuacaauugaauagagacaaaauaagauuagu
ugggccaagugaaagcccugcuugccuuugacagaaguaaaaugaaagcgcucucauccuuucccgagcggagggggacac
ucugugagugucccuuggggcagcuaccugcacucuaaaacugcaaacagaaaccaggugguuuuagauugaauguuuuuu
auuuaucaaagyuguagcuuuggggaggaggggaaaugaaaacuggaauaauuugaaaugauuuaauuuuauauca
gugaagagaauuuauuuauaaaauuaaucauuuaauaaagaaauauuuaccuaaa 76 AI121305   ccaauaccacagccgugaccacagccaagaccacagccaaaagccuggccauccgcacuc
             ucggcagccccuggcagugccuccauaccugcuuguuuucucauuaguaaacuccu
             cuucuaaagaaaacuggggaagcagauccaaccuccaggucauccucccgagcucauu
             ucaggcagugcuuaaacauaccccgaaugaagguuuuaugccucagyccgcagcuccac
             caccuuggaccacagaccugcaacacuagugcacuugagggauacaaaugcuugccugga
             ucuuucagggcacaaauuccgcuucuugaaauacuuaguccauccauccugcgugua 77 U35374    auggagaacgaguucacauacgaagauuaugagaccacugccaagugcuucugcaacac
             acugaauaucgaccucaaguggcagugaucugugguucggcuuaggagggcugacugcu
             cacuuaaaggaggcucagaucuuugacuacaaugagauacccaacuuucccaaagcaca
             gucaaggucacgcaggccgacuggugguuuugauugcugaauggcagaugcugugaug
             augcaaggccgguuccauauguaugaaggauacucacugucaaaggugacauucccagug
             agaguuuuccaucuucggggugugggaaacuuuggugguucaccaaugcugcuggaggacuc

TABLE 3-continued

RNA transcripts up-regulated during HF stem cell activation.

| SEQ ID No: | Access. # | Sequence |
|---|---|---| aaccccaauuuugaaguuggagauauuaugcugauccgugaucacaucaaccuaccuggu
uucguguggccagaaccccucuccggggccccaacgaugaaagguuuggaguucguuuuccu
gccaugucugaugcuuuaugaccgggauaugaggcagaaggcuuucagugccuggaaacaa
auggggggagcaacgaaagcuacaagaaggcaccuacgugauguuggcaggccccaacuuu
gagacuguggcagagagucgucugcuaaagaugcuggggggcagaugcuguuggcaugagc
acaguccccagaaguuaucgucgcaaggcacgugugggcuccgugucuuugguuucucacuc
auuacgaacaagguugucauggauuaugagaacuuggagaaggccaaucacauggaaguu
cuggaugccgggaaagcagcugcacagacauuggaaagguuugucuccauucuuauggag
agcauuccacucccggaucguggcagcuga 78  X15643   Sequence below.
uuccaggacagcuggggcuccacgagagaaaccccugccuccccccaaaaaugggcccaaaguucacugacaaacucacauuug
ucugauauuuagcuauguaacagcacuuacgguagcaauagaauuugauucucacucaucacaaugaaaauggcuggcgcuc
ucucucuccccucucucccccauuucaaaucugcaagcacaccccuuagagauggagagaauuugauccauuggagaaucgagc
uaaaaauaccaccauggaauuggguggaaggauuaaaugcaauaaugcacaaaaggcacaaugagcaauugcagaaugugucccuaaauguca
gccauuguuauggauuauuaguaaucuacaaaguaugauugcuuacuccgugugaaagacuuuucagucuaucaaacauaaua
caugugaaaucaaaccuugaaaauuaauuuuuucccaacagucaagacauuugccagcugcagagauuagcauucaugaa
ucuuagucuugucgauuuuuuuaaugggaagganggaacaacuauccucaacuauccuuuuuuuuuuucguaguuuuaaaau
gaacuccacaaaacaugguuuuaauauauaagggaauuaauaugaaauuguggggguggcagcgagguuaaaggcagaaauagcccc
aaugguggcacauucacugacacagcccuaaagaauuagcaaauuacccagccaacacauacaauuaauacaauuaauauuuu
auaguuaaaacagaguuacuaaagaaauuguuugaaaagaaaauuaugaagacuggaaagacggcucagugcuuaagagcuu
uggcuagucuuccagagaaccagggucauccagcacucaacaggcagcuugagcugauacuaucuguauauucaguccua
gggaaucugagucuuugccuugaccuccaaaacaggcacaaaugugggucacaggauugagauaagacucccaugca
cagaacauaaaauaacguaguuuaauuuuuuaaauugaaaacugaaaauugguugcacuguugcauuuuuuauuuuucagcacauc
cccagauauccgccauauaacaagaaaauugaugcacacaucccaaagaauuaagaauuacaccuccccaaccuacccaaaaugugu
auacucuaggucuaaagaaugcaaaggaugaaguuacugccuugugcgguucucaaggaggaggaugccaaaaaaauauu
uuuucacaaagugugcugagaaacucuguagcuguuggagucaucuccugugcucuugccaaauaacugaaaggggauaca
cuggauguucugugaauggggugucacuuauagagugcgggauccuggagugaggcacgugugucuggcaggcacccgcgag
cacuccaugucuccacaggagcgcuuaugugugguuucuuuccuccugcuucgggguguucggggguugunuacagccacc
ucucuguuggaccaggagacagcugcugcucccagaaugagcggccacggggugugucucggugggcuguggcuguggucg
gcauaagucugagcauguccuggucgucagggugcguuugugcugugugugcguguccgggugagcuugcucuuucuguu
ccuaaaagaaaaugcaccccugccuaccggcucagagacuccgcagaggugaccugaaccggacaggugacaccuc
cagacagcgccugguuggcggguugcacagcagccccagauuucucucucucuggucccccagcuagggguagcuggaagggag
cgguggccuggccuccggggagccgcuggggccccgccgggcuaaccccaggaggaggccggcuaggcugggagggguuagccc
uuggugcccuacgccucgccccggccagucgcggccgccggccauuggcccaaagaauuguucacgucacuggcaauuccccc
uagaagucuguggcacauaacgggcaggggcgcacugcaaggcgcuucucccgcauuuaggcugcgggugcaggcaccgcgag
cccggagcacccacgagcuuaguguggcaggacgcaccccagcacagccaccuacggccgcugaaugaagcuuccaggagugccg
cccccggccgucgccccgucggaggugcacccgcugagagcgccuggaccgaaaggccggugcgcucaccugcuaaccugcc
agccauggggccacacgggaacgacagcgacuucuugcuggcacccaacggaagccgagcgccacaccacgacgucacucagg
aacgggacgaagcgguggguugugggcauggccauccucaugucgguuaucgucccuggccaucgguguuuggcaacgugcugg
ucaucacagccauugccaaguucgagcgacuacaaaccgucaacuacuucauauaaucuccuuggcgugugcugaucuagu
caugggccuagcgguguggccguuuggggccagucacaccucuaugaaaaugugggaauuuuggcaacuucuggggugcgaguu
cuggacuuccauugaugugguugugcgucacagccagcaucgagacccugugcgugauugcaguggaucgcuauguugcuau
cacaucgcccuucaaguaccagagccugcugaccaagaauaaggcccgaguggucauccugauggauggauugguaucuggc
cuuaccuccuuuuugccuauccagaugcacugguaccgugccacccacaagaaagcuaucgauuguuacaccgaggagacuu
gcguguguacacgaaccaggccuacgccaucgcgucucgauuggucuuuucaacgccgccuccuggugggugaauggucu
uugucuauucccgggucuuccagguggccaaaaggcagcugcagaagauagacaaaucugaaggaagauuccacgcccaaaa
ccucagccagguggagcaggaugggcggacgggcacggacucccgaaggucccucaaguucugcuugaaagagcacaaagcc
cucaagacuuuaggcaucaucauggggcacauucacccucugcuggcugcccuucuucauugucaauaucgugcacguuauca
gggacaaccucaucccuaaggaaguuuacauuucccuuaacgguuugggcuacgucaacucugccuucaauccucuuaucua
cugucggaguccagauuucaggauugccuuucaagagcuucuugcccagucuucccuuccugaaaccuuauggggaacgg
cuacucuagcaauagcaacggcagaacggacuacacaggggagccaaacacuugcagcugggggcaggagagagaacaggaac
ugcuguguguaggauccccccaggcauggaaggcuuugugaacugucaaggguacugugccuagccuuagcguugacuccccaaag
gaaggaacuguaguacaaaugacucgccacuguaauacaggcuuucuacucucuaagaccccuccuugacaggacacuaacca
gacuauuuaacuugagugugaauaacuuuagaauaaaauuguauagagauuugcagaagggggggcacauccuucucgccuu
uuuuuaauuuuuauuuuauuuuuuagcugcaaacaagagagaacguauuuagagucguuauuguucuugauauaguuca
guuccucuuguauggaacuuaaagguuucugucgaagagguguggucuggagcugagucugucugucugucugucgucug
ucugucugucuggaugauguuuucauguauucuacucacuggucaaguauuaagaaugauauauauuugcugcuggaaaucc
auaucuaaaggagagaguuuucuuccuguacccuuggacuugaaauauccugugucuuggaccuuucugcugugacaaugg
gcccuuucucucucacuccacuuauuuuacucaaauggauucgaggcagggauuugagggacaacacuaguugguuuugucuu
uguuuuuguuuuuguuuguucgguuuugucguuuuuugguguguuuuuugguuguuuuuuguuuuuu
uuugggunuuuuuuuugcugagaaaagucuaaagguuuuacaguaaauaaauuguuaaccaugacuucauugcacccguuu
cuucaaaaccccuuugacucugggagugucccuugucucuccccacuggaaaccacagguaaacuaugugucgugaccgaugagug
gcuuaagguguaagaguaccagaauggcaugcuugcaugcaccgugccuagccccuucgugugugucuucagagcuccaga
ugcaaaccuugccuuccuaacuucacucgugucccaaagcaguccugccuguucacgacauaacccaguaugccuacag
uugcucuucugugcugucacuccagaaaccucugacucacggaaacagaguuaggacauauguuuuugucccccauaugcuc
ugacaccaccuucagcccuuacugguuucaauaacugugauaauuucaucacucgcucucucuacaguccauugccucacccg
caucagggcuuggugugguucaggaugaggaagaugucuguguaauacucuuucaagcaucuagaaaauucugagggaaauc
aaaggccucggucagagagagagagagagcaaaagcuuuaaaaaacaucggugaaugcuucacgcccuucagccucuc
cucgcuccgucugcugucccgucgucucucguucccaauucucugcacuucuguguaaaccaggcuucccaugucuggcauu
ccgugcauuaugaugauauuggcggcacgucugugaccaguaaauucggguagcaccccccuaguuacaauaaauugcagacacu
cagcgcguacgaccccccuaguuacauaugcagacacu TABLE 3-continued RNA transcripts up-regulated during HF stem cell activation.

SEQ
ID
No: Access. # Sequence

79 AI849109  uuuuuuuuuuuuuuuuaagcguccaggcguacuuuauuuuacacaaguggugccc
            agaaccacagggacaugaccuggagaguaggcacagugccugaggcugcaagagccaaaua
            cagggauucaugccuucuccuuggucccaugaccaaauuaaaaaaaaaaaaaacaacaa
            aucacacagcacacaucgccacacccauccccuccuuccuuucagcaacagccaauucag
            cuuucuagccaaagacaguggcuacaacugaauuuacagagaaccaugcagccaagaaac
            cagagccacggagggggagaggcuugcguugacuuccacaugugcugucccauagcagcu
            gagugaccccacca 80 U70132   agaaagauaagggccagcaaggaaagaaugaggaugugggcgccgaggacccguccaaga
            agaagcggcaacgccggcagaggacucauuucacuagccagcagcgcugcaggagcuggaag
            ccacuuucagagaaaccgcuacccagacaugccacucgcgaagaaaucgccgugugga
            ccaaccuuacggaagcccgagucgggguuugguucaagaaucgccgggccaaauggagaa
            agcgggaacgcaaccagcaggccgagcugugcaagaauggcuuugggccgcaguucaacg
            ggcucaugcagcccuacgaugacauguaccccggcuauucguacaacaauuggggcugcca
            agggccucacgucagcgucucuguccaccaagagcuucccuucuucaacuccaugaacg
            ucaaucccugcucucucagaguaugguuucccgcccaacuccaucucaucuaugagua
            ugucguccagcaugguggccccucccgcgugaccggcgucccgggcuccagccucaauagcc
            ugaauaacuugaacaaccugagcagcccgucgcugaauuccgcggugcccacgcccgccu
            guccuuacgcgccgccgacuccuccguacguuuauagggacacaugaaacucgagccugg
            ccagccugagacugaaagcaaagcagcacuccagcuucggcuacgccagcgugcagaacc
            cggccuccaaccugagugcuugccaguaugcagucgaccggccggugugaaccgcgccca
            gggcgcggggauccgaggacugucggagugggcaacucugcccagaaagacugagaauu
            gugcuagaaguucgugcgcacuaugggaaggaagagggggggaaaaaagaucagaggaaaa
            gaaaccacugaauucaaagagagagcgccuuugauuucaaaggaaugucccccaagugucu
            acgucuuucgcuaagaguauucccaacaguggaggacgcguacgcccacaaauguuuga
            cuggauaugacauuuuaacauuacuauaagcuuguuauuuuuaaguuuagcauuguuaa
            cauuaaaaaugacugaaaggaugguauauauaucgaaaugucaaauuaauuuuuauaaagca
            guuguuaguacuaucacuacaguguuuuuaaaggcuaggcuuuaaaauaaagcauguuau
            acagaaucaguuaggauuuucgcuuugcgagcaaaggaauguauauacuaaaugccacac
            uguauguuucuaacauauuauuauu 81 M13805   cugagaggccagguggggcgccgaaaucaacguggagauggaugccgcucccgguguggac
            cugagccgcauccugucagagaugcgugaucaguacgagaagauggcggagaagaaccgc
            aaggaugccgaagacuggguucuucagcaagaccgaggagcugaaccgcgagguggccacc
            aacagcgagcuggucagacggcaagagccgaaucuccgacucagcgcgcaccaugcag
            gcccuggagauugagcugcaguccccagcucagcaugaaagcaucucuggaggggcagccug
            gcagagacagagaaccgcuacugcgugcagcugucucagauccagggggcugaucggcagu
            guggaggagcagcuggcucagcugcgcugcgagauggagcagcagaaccaggaguacaag
            auccgcuggaugugaagacaaggcuggagcaggagaucgccaccuaccgccgucugcug
            gagggagaggaugcccaccugacucaguacaagccaaaagaaccugugaccacccgccag
            gugcgcaccauuguggaagaagucaggauggcaaggucaucucaucccgggaacaggug
            caccagaccacccguuaaggacucagcuccuuccgcccaguucccgaggcugcagagag
            gcagcuucccucuccgcuccggcaucacccuccugcuacagccucuccccagcauuccua
            ugcuugagaccauuaaagcuugcugaccugaagugaacugugggccuuuguucugaacacu
            gaaauaaaugaccauggugac 82 AV138783  ccccaggggugaaaugaggauucccccacccugcggaacagugaaaugguauaauuaag
            aggagggcgacgaccccuugccgcgggacccgggacucgagcccgggacuucgcagcuaca
            gcaaaucuauuuuuaauauugugcugagcaagacagaucgcuugcauauuuuuaaaaauu
            uuuacuacagagacauuccaauaaauucguuaagcc 83 K02927   Sequence below.
cugacagucgucucuguccuucuucgccucggagcugcuaacugguucugaaccucucagcacuucagcuucuagcggcga
ugcauguggaucaagcgagaugggccgccaagagcgagguuaugguugacaaaauucaucacgaauccagaaacucuguuaugg
acucaacauggacuuuguugauccugcugcagaucaccaugaaaguaauccaaggccuauaguggggucaccacaguggaa
cuggacaccccuggcugcugagaacagccgcgaccuugaccgaagcacccugcuaugccuaccggcagcaaggagaugaccg
ucucuaacuugcacaaagaaacaaagaaaguguucagugaugugauggaggaucucuacaacuacauaaaauccgcacaacgg
cagacacucucccaugguggccagcucaacacucgacauuguuauggccaauaaggaucgccugaauucugccauuaucuau
gaccgagauuucucuuauaacuacuuuggcuuuaagacacuggaacggcauauuuuguugaagaucaaugguaaagugggcu
gaaagaccacagcauaugugaugagggguucugugggcaaucaacaagaaugaugcugaauauugucuaccaaccuccuacc
uacuuucugagaaguguuucaucaugccccuccuacucucuucaaugcugggaccaaccgcccacagcugucuagcuguuuu
ccucuugaguauaaaugacagcauugaaggaauuuaugauacucugaagcagugugccuugauuucuaagucccgcugg
gggaauggugugcugugaguuguauucgggccacugguagcuacaucgcugggacuaauggcaauucaauggccuug
ugccaaugcugagaguaauauaacaacacagccucaugugguugauccaagaaucaagcccaggcgcguuuugcuauuua
ccuggagccuuggcacuuagacaucuuuugaguuccuugacuaagaagaacacaggcaaggaagaacagcgagcacgcgau
cucuucuuugcacuuuggauccccagaucuucaugaagcgaguggagacuaaccaggacguucauugaugugucccaau
gagucccuggucggacgaggucuggggagaggaguuugagaaguuauaugaaaguuucagagaagcagggucguguccga
aagguguaaaagcucagcaguccuuuggguaugcaucauuugagucgcagcggagaccgugaccccaucaugucucucacaaag
auuccuguaaccggaagagcaaccagcagaaccugggaaccaucaaaugcaaccugugucacaaauaguagaguacacc
aguaaagaugagguugcaguuuguaacugggcuucucuggcucugaauaugauaugucucaccggaacaucguaugacuuu
gagaaacuggcagaagucacuaaagucauugucagaaaucugaauaaauaauugauauaaacuacuacccuauuccagagg
cacacuuuaucaaacaaacgccaucggcccauuggaauuggggauaacaagguuuagcagaugcuuucauccugaugagauaccc
cuuugagaagcccagaagccccaguuauuaaauaagcagaucuuugaaaccauuacuauggagcccuggaagccagcugugaa

TABLE 3-continued

RNA transcripts up-regulated during HF stem cell activation.

SEQ
ID
No: Access. # Sequence cuagccaaggaguauggccccuaugaaacguaugagggaucuccagucagcaagggauucuucaguaugacauguggaau
guugcuccuacagaccugugggacuggaagccucucaaggagaagauugcaaaguauggauaaggaacaguuuacuuauu
gccccaaugccuacugcuucaacugcccagauucuggggaauaauagaguccauugagccuuauaccaguaacaucuacacuc
gaagagucuugucaggggaauuucagauugugaauccucacuuacugaaagaucuuacugagcggggcuuguggaaugaga
gaugaaaaaucagauuauugcaugcaauggcguccauucagagcauaccagaaauuccugaugaccugaagcaacucuauaag
accgugugggaaaucucucagaagacuguucaagauggcagccgagagaggugcuuucaucgaucagagccagucuuuaa
acauccauauugcugagcccaacuauggcaaacucacuaguaugcacuucuacgguuggaagcaggguuuaaagacuggaau
guauuacuuaaggacgaggccugccgcuaauccaauccaguucacucugaacaaggaaaaacugaaagauaaggaaaaggcac
ugaaggaggaggaggagaaggagaggaacacagcagccauggugugcucuuuggagaacagagaggagugccugaugugug
gauccugagaaaagcggggccugggagacgcagcgggcucuccugcccgagaggcagacgauuugagcauagauaggauagu
gggguugcuugguuaucagcagcucugcuuuggacgugccugccaggacagggagccacgacuacagauacuguuucuacac
aguguaaauaucauuuuuaacaaacagaaaaccaaagccagcuuuugauauuaggaaucaaggguagaggcuuugggaauacua
aagagccuuccugcaaauaguggaggagacuuaggaagucucgucucuccagcuuuccugccuggccauucucaguuuggg
caaagagauuuaguuugauuugacugauugccuagaaguaaaaucaagcaauuacucaucagcuaaagaccuuugucuagac
aaacuucuauaagucauuuugaaauaaacauuucuaagugau 84 X07699    Sequence below.
uugccucagacgcuagcuguagcuggcaggcgguugcuacgugcuccagagucgucgguacccgcuacugcagucgcuuucg
uguggcuuccgcugagcucuuccgagcugcucgcucuccacacgcgccgccgccguaauccgccaccauggugaagcucgca
aagguaagaggccuuggcgcgccgacgcggacgacuaggcccccugccuuucggagggacgcgcgcgccgcccguccgucg
cggaggggaggagggcuugcgcgcaauccccgggcgcguucgagggcgccaugcugggggggaaagucucgcgcgacuagcg
ggaggucucgcggugcuugcccucugacuuaggggggaugagaagagcggaggcaggguuuccggagggcgauaucgaggg
uucggauguagcgggcgggaggggacggugugaggagaacggaggagcugagagcggauaggggcacggcgugggaaga
gagggccaacuuaaggcggcgagcggucccggggccccgccuccccgcgcacggccucugggcgcgcccgccgcacgugcucu
gcggagccccgcacgugucgcgcgacccggggcaguggggagugucuguaguacccgcgaaaggggagacggcagcgugg
gaugggaugggugggccggcgaucugcugucucugccggugaccgggauggacacgugguggaccccugagguggcggcu
ggugacuccacguggugggcuggaagcgagagaaaguggggaagcaguugggguuacguggugcugcuuuaagagguugauu
ucgagauaccccuucccagcaaauaacuuaaagggauccccuuuaacucugguuuuuuuuuuuuuuuuuuuuuuuuu
ugugggaagaugccagaaauagauggccaggauuaggagacuuuauaaccugugcguguuucuuggguguagaguucuguc
ugcucaguuaucugugagaaggaaaaaaaaauuaugcgcgguucgcagaaaaacugccaggagaaugccaugccuggccaa
gaagaagucuuuaugcuugugucuuuaguaagaaaaaggguggugggccaaggcaaaguagacugaaaaugcgugcaauuuuu
uguguguuuuguaggcuggcaaaaccccacggugaggccaagaaaaauggcuccuccuccaagaggaggugggaagaggauagu
gaagaugaagaaaugucagaagaugaagaugacagcagugagaagagaggagguaaggaucuauuugcagcgaauuaaaccgg
uggaauugaaugucuggaagucuuagaaaaucaggauauguaguaaaugguugaauggcaagccccuuccucccuccccccc
uccccucccucccucccucccucccuccuuccuuccuuccuuccuuccuuccuuccuuccuuccuucugcaagacagucgcaaaac
aggggacagaaacaggcagaaauuuggacuugccaggcaagcagggaguaguacauggaaaccuugucucaagaccguugu
auggucaugcucaaucagauuucuuagaaaagcucagggucugagucaguuuuuuuuuuuuuuaaaguauugaaagccaug
ucuccuuauuucaggguuuaauguuuaaucuuugugugugcgcgcacccauuaagcaugcuuggguaccccucauacuagaaug
uacuuggauccccuggaacuggaguuaaagccacaugugaauguuacauguuacaagaguaaacauguugcuuaacuuuug
agucaucucuccaguucuggguuuuuuuuuuuuuuaagcucauucaaguguccauuuucuuggucucaaaguuag
ucucuuaaguuagcauuggguauaaaggaaugcuuaugauuugugugcuuucaagguugucaucccucagaaaaaggcaa
aaaggcuaccacaaccccagcaaagaagguggguuguuucacaaacaaaaaggcugcaguucccacaccagcuaagaaagcag
cuguugaccccaggcaaaaaggcaguagccacaccagcuaagaaaaacauuacaccagccaaagucauuccaacaccgggugaaga
aggagcugcacaagcaaaagcguuggguaccaacucccugguaaaaagggagcugccacugccuaaggggcguaagaacgg
uaagaaugccaagaaggaagacagugaugaggaugaaggaugaagaggaugaagaugaugcgaugagggaugaagauguggagaugag
gaagaggaugaguuugagccaccaauaguaaaaggagugaagccagcaaaagcagcuccugcugcucugccucagaggaug
aggaagaugaugaggaugaagaugaugaggaagaugaugauugaagaggaggaagauggugaguuagaucuuaggauauuua
ggguacugcauguacauuccacuacugucuucuauuaagaauuaaaacucuuaugcuccuuaguucuuucaccuaacuuaaua
ggguuucauuugcuaagagauuuggouuuuuuuuaaguauuuguagcauuucuugucugauuugguaguagcaaau
acauuugccugauuugccaucuuucuccagacucugagaaagaaguuauggagaucacaacagccaaaggaaagaaaacuc
cugcaaaguuguuccuaugaaagccaagagguguggcugaggaggaggaugaugaggaagaggaugaagaugacgaggaug
aggaugaugaggaagaggaugacgaagaugaugaugaggaagaagaggaggaaggaauaacacauauuaacucuuuuaaaguaugc
ugaccuaaguaaggcuuacuggcuaucuggaaagucugcuuauagguucauuuaaaaacaucuagaaccugauuaa
gcagcaccugggaaacggaagaaggagaugaccaagcagaaaagaagcccugaagccaagaaacagaaaguagaagguaagcc
ugcaaaaacuggggaaacagaucagaguagcacuagcacaagugaugaaugacaaagggacuuaauacugaaccauggggguug
aaaugaaauaugcugaugugcuuuauaguuuaaugaugaaauuuguugugugcuuaaguggggcugaaaguucauuuuuugu
gugugcaggcucagaaccaacaacaccuuucaaucugucauugggaaccuuuaauucuagauaaucaaguauggauuuaaaa
uuugccaucagugaacuuuuugcuaaaaaugaucuugcuguguggaugucagaacuggauacaaauaggugauuuaauu
gaauguuacauguguauacagcuagaauuuuagguuccaguguauucucccugccuuuaaacauggggcuauaucuaac
uaguuuagauaaaagucaguugcucccucguggccuuaaguacaguuaaggagcucagauaagaaaagacuauaguauuga
acuaaaaugcagucuaagggccugcaauuugaaguuccugugguucuggaaaauaaaaaaauacaagcuguaaugaaaaaa
aagauauuuaaacacauaaaauuuugucaguauucuacaacuauggaucaucauaaugcuuuuagcuaaaagauauucu
cuguacuuuuagcgggguccaugcugcuacugcuguuuauuacaauauacugaaugaagaaaucgaggugaauuuguugu
aaugucuugguacauggacuuguuugguuuuuuguuuuuuuucuuuaagauuuguuuauguauaugagcacacuguag
cugcccagaugguuugguccucaucugggugugguggaauuugaaauuuaggaucucagcgucucugcucucucagucc
ugcuugcucuggcccaaagauuuauuugugguuuauacauaaguacacuguagcugacuuuaagaugcaucagaagagggcau
uaggcucucauuaugggguguggugagccaccaugguggucuggauuugaacucaggaccuucagaagagcagucaaugu
gcuuacccgcugagccaucucuccagccuuuggacuggguuuauggaagauaagggugaucuaguuauuuuuguuag
ucguagaugcucugugugugccacauggauaagcagacaccuuccucaccuguaacucuuguuuccaucu
ucaaggaaauuuggguauguagucguuucuaggagaccuagaaaaggccuuuggcucacuguguuuaaaagugouuu
ggcaaugaaauuaaacugaaaaaccaaaaggaagagauaguaaagaaguauguaaggggcucggguugacuggauacuaa
cagacuuaggcagucuggugccucuuccuuaguuucauccucauuugugaaccaaugagaugucuagggucauguccuugu
gacaggauuugauuccugggauauauaaugucagggcugacaggaggaauagcuuagugaguaaagaugcuugcugcaaaau
guuugaucucuagaagccacaugaagagagaagaaccuuuaauccaguuggugaucagaggcaggcagauuucagagu TABLE 3-continued RNA transcripts up-regulated during HF stem cell activation.

| SEQ ID No: | Access. # | Sequence |
|---|---|---| ucgaggccagccuggucuacagagugaguuccaggacauccagggcuacacagagaaacccugucucggaaaaaaaguuuua
gcuuauccucugaccacauguguaucgugacaugcuugaagcuuacuuaucucuuaaaugaauucuugaucccuauauuuu
gaguuucagaauuuggauuuuaaagguuuguuucuuaguuugugcugaaaaauugaacgugggcuuuucacaugcuaggcaa
auuuguggguuuuuuguuuguuuuuuucucaagacaggguuuucuguguagccuggcuguccuggagaccaagcua
gccuugaacucagaaaucugccugccucccaagugcugggauuaaaggcgugagucaccacugcccugcuaggcaaucacuc
uuaaaacugcuacauauccucuguccccuuuugcucauuuuacaagguugcugugugcucaaucugcagucuauguuauau
gcuuacuggaucuaggcuuuuggauguagaaugaaccauaugagugagagguaucuuagagaugaaacuaagucuaaaua
gacuuguuccauauacaacuuaauacauuauggucuaaggaacaugauauacauguaaacaaguaggaaggagauaagucugg
uguccagggaagccaggagagccucaucugaaacuggacagggguuugugagucaucaggugacaauugaacauaggguacu
cuucaugcaaaugguuaguaaccauugagccaccucuccaucccuuuauaccauuuuuuuuuuuagcauauauaccuuguac
uuuauaggaauuauuugcuuuauucucuugugacuuguaaaaugaacuuaauuaaaucuuuuuccaacauaguucga
gcugcaagaacacuucuagccaaaaccucucuuucaacaucacugaggaugaauuaaaggaaguguuugaagacgccaugg
agaucagauuagucagccaggaugggaaaaguaaaggguaguuuugugucuuugaguguaaaguuuuauuaaguuuagu
gucuucuuccccucuccuuguccuugacagucucuagucugcugcuucaaacuuaacuucauaaccagaaauugaauaucu
ggccucuggccucuaccuccccaaguucugacauuaaaaaaugcucaaugugggguuuugaggguguaucaauuuuacag
gcucaauccaaauuggcaucuuuugccacaaguacuauccuucccuauuuuaugagagaaaugugauucuaggcaguucag
ucuauuguguuggcucuuuuuccuccucaccaguuuaaaggaugaagaugagcuaauacauaguaaaagaacaguaaaagca
caugugacuaaguccuucaugucugauguugaguaauauuuucucuaacguaguaacugaauugucuuguacucuuucag
gauugcuuauauuugaauuuaagucugaagcugaugcagagaaaaaauuuggagaaaaucagggggcagaaauugauggacg
aucuguuucacucuacuauacuggagagaaaggucaaaggcaagagagaaacuggaaagaccagcacuuggagugguaaguua
aaggguuuauuguguagugggaacaggaaucauuuguaucuuuguauuuuaaguaauugguuaccuacaauuaguucacc
uuuguucauauagcugauguuuagucuucaugagugaaagcuauuugaaaucauuuccuuuggaguauaguaggcaaauaa
agcuauuugugugguuguuuuacuuuaaaauggcuuaaacuauuuuugaaaauaguguaagacaacaaagaacaguuau
cuaauuagaaugaaaaugaaaggagcaaagaaggcauuacuguauauaauggauauacacuggugguucuagaauuaugguu
auaugguacaugguugaagugccauuguuucaguuaacauuccaguaaccuuguggauuagguuggagacaugcuuuauag
gugacccacuuacugaguguuuaaauauacacagacauacucuaacauaccuugcuaaugugguuaucuuuguauuugcagg
ugaaucaaagacuuugguuuuaaguaaccuuuccuacagugcaacaaaagaaacucuugaggaagaauugagaaagcaacu
uuuaucaaagugccccagaacccacauggcaaaccuaaaggguaaaaauuuuuacgucugggucuggacauacaua
cucuuacguauaagaguaagacuguccuguuagcuuaaaaaaaaaacuaaaguuuuuagcuauacaaagggcaguaaauauuga
uaguaaauuacaugeugaugccaaguguuucuaagcuuuauucugagaacugacuuucaaccuucagguaugcauuuauag
aauuugcuucauuugaagaugcuaaagaagcuuuaaauuccuguaauaaaauggaaauugagggcagaacaaucaggcugga
guugcaaggauccaauucgagaagucguaagucuuaacaugauaugucuggguuggauuuuuuuuuauuuuua
ugugccuauaugcucauuuggggcugucuuuauguuguugcugagaaaaugacaacuggauaugaugacugauuaccuga
gaaauaauugaugaaaucaagaaaaauccucuagauaugucaaguucugauccagcuaugucaacucaaagcagcaaccuu
gauugcccucugaguacgcuuuuuuuuugauccaguguagucuuuuuuuuuuuaaccuuaauuucuuguguuaauugcuu
uuucugguaaagggggaaaaaaagacauaacaaaaucaguguaagggaaggcucaguguugagcacugagaggaccuggg
uucaaauccagcacucacauggcaccuaucgagacaggauuucucuguguaguccugccugucguggaacucacucuguag
accaggcuggccucaaacucagaaaucugccugcucugccuccuaggugcugggauuaaaggugugcgccaccacugccca
acccugucuguaacucuuaagaucugacauagauugcagacaaaacacuaaugcacauaaaaaauuuuuuuuuuuaaaaaa
ggaaucuacuucagcugaauguggcaguauggcaguauucaccaagggucauauggaaacaggaaauuuuucucuuccaga
accauccaaaacucuguuugucaaaggucugucugaggauaccacugaagagaccuuaaaagaaucauuugagggcucuguu
cgucaagaauagucacugaucgggaaacugguucuccaaaggguaagaaggcguaguaguguugcugcuuuuuagugaa
uucugcauggagaacuugggucugcaguaucuucucaugagcuccuuucuguccaucagugauagauuauggauucgcac
gagaagaagagagaauucacagaacuggcacuuaucuucuguuuucagaguaaauuuggcuguuugugugagacauuau
gagauacuggcgauuuucucgaccugaagaguacuuuugucacucuacuugggugacuugguacuuauuguuacuuua
aaauguguuacuuaauggugagguuuuuuuguuuuucuuucuguuuagguuugguuuguagacuuuaauaguga
ggaagaugccaaagcugccaaggaggccauggaagauggagaaauugacggaaacaaaguuaccuuggacugggccaaaccu
aagggugaagguggcuuugguuggucgagguggaggcagaggagguuucggaggcagagguggaggcagagguggaagagg
uggauuuggaggaagaggccgggaggcuuuggaggaaacuggaaacggaaacuggaucggauuccuaaaccugugcc
uaaccaaccaccuuaaaugggaaggucaguccuaauuguaucacccuuugauguuuuuccuuccuauagguagaggaggcu
uccgaggcggcagaggaggagggggagacuucaagccacaaggaaagaagacgaaguugaauag 85  X57800  Sequence below.
uuagacgguugcgcgcgcagaggguugguaguugucgcguguaggccuucgcugccgcuucugcaucgugaaucgggggac
cuuggcagccagaccucguuccucuuuagaguagcucucaucuagucgccacaacuccgccaccauguuugaggcacgccuga
uccagggcuccauccugaagaaggugcuggaggcucucaaagaccucaucaaugaggccugcugggacgucagcucgggcgg
cgugaaccugcagagcauggacucgucucacgucuccuccggggucuacucggcguccgaaggcuucgacacauaccgc
ugcgaccgcaaccuagccaugggcgugaaccucaccaggugagcggguggcgggagcggggcccacucuucccgcuuccgc
ucuuuggcgggcugugacucugcacgcucauggcuggcuuggccauccgcgcuuucugauuggucuauggugucggggg
cagcccucaccaaagcgcgcggguuccgaaaagcccgcgcuggcaguggcgcccacucuguuuccgcgccaaagccacaaagcg
ggaguccgcgggaaaaugagugcucggagcugggcuugcauuaaaugugcuuucugucagaggugcuguuagcgccuaau
aaacgagucuuagugcaaauguaaugucgacuuagagugacaauagaccuuucuugacuuccagagucucacugcgcauca
uggauuugaggggaaaucugucaguuuuagcuuuuaacuugcuacagcuaccuagguuagugcuccuguauacguguu
caaggacagugugugacuuauuuuaguacagauacauggauuagugccacuuguauacauuuugaaagauuuacgaaagg
ccagacguguggggcucaauuccaguacacuagaaaccaaggacccgcucaaaaagugcuuuucugagauuguuuuagugcu
uuuagugcauuuuacuaagucgguuuuuaagaaucacauauacccgguaauuugcuucaccccugagaguguuuggguacc
cuuagccccuuuaacaguucuccaaccgugagugugaaaugugacaacuuguaauugcuuuuaaaauaugauguggauu
acauguugauaaagccugucuuuuuuuuuuuugggggguagcaugccaaaauucaaaauugucgguaaugaagacauca
uuacauuaagggcugaaguaaaugcagacaccuuagcacuuagcacugaagaccaccauguaaaguaacuuuuaaaaucg
gaguuacguguuuguuuucaaaaccaaaaaauauuaacaauauuguaaauuccaucaugauaggaccguguugugcuugguaacauuuccuucuuuugugaucaagagaaaguuucagacuaugaaaugaaguuaauggacuuagauguggagcaacuuggaauccccagugaguuaccuuguuucugauuguguguuacccgcugugauaccagcugaugcguuuc
ugaguggaguggugguauuggggaugaauggcacacugccauuucacuaaaccacagcagucuaaaguugauugaguuuua
aagaaaccagaagucuugcauucugaguucugguuaagaugcuaaauucuugagaacaugaagcugagccuuccccuuuucu

TABLE 3-continued

RNA transcripts up-regulated during HF stem cell activation.

SEQ
ID
No:Access. # Sequence agacugaccuuuaacuuguggguuuacaggaacaggaguacagcugoguguaauaaagaugccgucggugaauuugcacgua
uaugccgagaccuuagccacauuggagaugcuguugugauauccugugcaaagaaugggugaaguuuucugcaaguggag
agcuuggcaaugggaacauuaaguugucacaaacaaguaauguggauaaagaagaggagggaggccggugaguaguaaggggcgu
ccaguuaggugucugaagcagggauggagccucggcuuuuguuuuuauuuauucauucauuuugagauggagucuugagu
agaccaagcuaucuuagagcucagagacgacuccauaagcuuuuacaggguagcauuuggaaagcuaagugguacagccuuuug
cuuccuggaaauacucuuuggcaaauaagugagggguuggcaagugagcaaaagaaaauggguuggggugugauaugu uagcuuuau
guguugcaggguucaagaguauuugcagucccaagggaaaauaagaaagacuucaccaaaauguggaaagaguugguauuaaaugc
ucuugacaguuacauccauagagaaagcugggcaugaugucucaaacccacaacugaugguacucaaagcuacagcaggaaga
uucucagcuuaaagucaaccuggcagaaaaucuagcucaaaaagaauggagggaagaaauugggaaggcaaaggaagauguucu
ccgaguccuccucauucaaguagaacauacuaggccucuuuaauuucuaaguaucccugaaucgaggcuuuuucucaggaau
ccaaguguauauuucauggcuacacuuuuuuuuucuuuuuuuaaguguauaaauaccugaucuaauagugguauuucugaugcua
cagugagccuguuuucuccucuagguaaccauagaugugaugagccuguuucaccuaacguuugucucugagguaccugaac
uuuuucacaaaagccacuccacugucuccuacaguaacacucaguaugucugcagauguggcccuuggugaagaugauaaguu
ugaacauuguuuguaaauggguauuuauaguauucggugguuuaauuuuuccugucuuucaguuguagaguauaaaauu
gcugacauggggacacuuaaaaguauuauuauggucuccccaagauguagaauguaggagggagacuaagguaucuaagaaaauugag
aaaacuaaaccuuugaagauugcuccugaggaugccagcgucguguccugaggucuuuucugucacccaagguuuguaaccugaguau
ucuuaaaauauuaaaauaaaauaguagauaucuucuguaaauaaccuacuuucuuuucucuccauucuccauaauuuugcuuu
aaagaauaagcuccaaaguaaaaacuaguuuuguuaaacaugaauguuucugcuuuacaaauacggugauuuuccaucaaug
aucuugacgcuaaaugcaguuuaagaaauauuguucaauuuaaauaaaguuaacaauuugaaaaguca 86 M35247    Sequence below.
ggugcaggauguaggccugcagaauugucagacccaguggcgggcuuuugccacuggaagaauuuccaacauaaaacaga
ugaucaguuuggacaaucgauucugcgaccagaggguaguguuauuuggguuacuuuuaaaauucagauugucuggugu
uuuccaaucacuccgacuguaauuugaaguggguucuuaagaaagccgucugucguucuaguuuuauaaaagcugu
ccaagaucugcccaguccccagaugucccugggccucuucagggccgugggugucgucugccaacuucugcagcuggaugccagacc
auccuggacucuggaucccuuuugggguauuucuuacaccgcugugucccggccuggccuuggggagcccuguucauaaucg
ucggcuaugugggacgacaugcaggccuugcgcuucagcagcaaggaggagacuccgaggauggcaccgcuggcuggagca
ggaggagcaggugacuggggacgagcagcagacugauaugcacaaauccaaggacugucgaaaggaaucugaagacccc
uagguucauuuuacaacaagagcauggacgacucucacacacuacaguggcugcaaggcugcgaugugggagccagaucg
gcaccuguguccucuggguacaaccagcucgccuaugauagcgaggaucuccccaccccugaacgaaaacccaaguuccugua
caguggggaaacagcacuguaccucacaucucucagggaccugaagagccacugcucagaucugcugcagaaauaccuggaa
aaaggggaaggaggcugcugcguucagacccuccaaaagcaacaaggaccggcaccccgaaccguugaggugaugucac
ccugaggguguugggccuggggcuucuaccucugcugacauccaccugaccuggcaguuggaaugggggagcugacccag
gacauggagcuuguggagaccaggccugcaggggauggaaccuuccagaaguggcagcugugguggugccucuuggga
aagagcagagauuacaacauccauguguaccauggggggcugccugagccccucauccugagauggggagccugcauggua
ccaaaagccuuggauuuggauuuuugccauggguuuucauuuuguucauucuucgugggggugacauggcau
gaagaagaaugcaggugggagaggaaggcgugacacccaagaagcaggcagagacaguccccaagacucuagcaagacug
uuguggaugaugaggaugugggguuugcuuuugaagauuaagccucuaaaacuugcuaggccacuccccaggaac
uucagguggcgagucuuuacugucaccuugacuggauuuaggaucaucuggggagaugccccuuugaguggcuggggcuugg
ugaggacagcaggccaguucuugccaccuccuggacagaaacaucucaccuuuuccuggcucaaggaucugaacaccugucu
cuugccuacucgggcuucuagucagggcauuugugcaccuuugcaagggguccaggggacacaaagcucccuccucucaccca
cagcacuccugggguccuacccucagugcuucagggacauuuaaucaggucaaaaugggaucaauggcuuugaugcagaaa
agaacuguggacuaaauagagauagggguuuaauuaaaaaauauaucuuuuuaauuuu 87 AI553024  cuggcacggacaugguugucuucuugucgucuguggaaaacgcuuucaggcacaaagcg
             cacuccagcagcacaugggagguccacgcagggucugcgcagcuauauuugcagugagugca
             accgcaccuucccagccacacgcgcucucaagcgccaccuucgcucacauacagguuuuuu
             uucuccaugugucaccaagugaaguuugugccuucauagcaaagagaauauuuuuaca
             uccuacuaacaguagauuuuuuguagugaacauuuuuugauuuuuauuuauaagucuc
             auaagaaaaaagcgauguucaguugauaccuugaaucugcaguuagaagagaauaaag
             uuaacuc 88 X16995    Sequence below.
ggagccccagugcaggaggcugcgaaaguuggggagugugcuagaaggacugcggagcggagcgcacgcgggaccaggcu
gcgacugggucgcuggucccggccacagggagugggagccgcuggguagguaccccgcagggagcguguuucuguuucua
gggacagugcaugaaagagauggggguguacgcgcgggcgaaaaggaagggguguuucgggucggcuuacgaggagggggug
uguagggugcauuuuugguauuaaaagguaucuuggaguagugaggugaggagccaggguagauuuaggaaggaaggcccgaag
ggucugcaaggugcuuguuuuuggguagguaguggggcgcuuguuuaggagguucccgcuaggaucuccagugugaggca
cucuguacucgggguuugggugugauugccggguagggggguugucugagcauggacuggggaaaggguacucagagcuuc
ggcguugcugggggauccauccaaguacaaguaagauuggauuuccacggucucccuucccggcucucagcccccuuuccag
uguuuacuuaaucaucauaggcuguacuuagauuuuucuuuugauuccuuuaccgaucuuuuccugaaccgucuggaagac
cugggggguugcugaaggaaauggccagcuagguuugcugguaauggguuguuagacuaaguugcagaguaucuagaa
accuaggagcuguagccuggugcagcuacaggaaagccgcacguggagccuggguggaaguugcucacgauagagucucgau
guaguacugacuagggggggagacccccuucugucaucagacagacuuguauccccagugucuuuugaaucguuagguag
ggugcagccugcggggcuuggucaccuaacagggguugccaggaccugccccaagccggauucucccacucccucuuucaacc
ccgcucuucccuccucccuugagacaccccaccccccucagggaggcuagaugcagaucugauaucuugugguugcugacuaucgg

TABLE 3-continued

RNA transcripts up-regulated during HF stem cell activation.

SEQ
ID
No: Access. # Sequence ccugaagcugggguagauuggugggggugauccggauguaggaugcaaguggagaaacaggauuugaauggagcuggaa
caaacgcccaguccugacugcugccacccuucuuccuccacccccaaccauccccuucccaggcuucuugcaaacagaggcag
aaguggccauauuucuuucuuucucccaggugcuguaugcccuagggacuugacacggggcaggcggggugggaacugguu
ggggggggacgugcuguuuuauggaagucguaugccuagccagcgguggagcugucccuggcuaggcacccaggggugu
gugggggaaugggagaaauacugggacuagagggucucaagggccagcaggugugauagucuuuuucuccaccccaccccuc
ugcuccaccaccccucugccucagcaccccucugccucagcaccccucugccucagcaccccucugccuccagccacccucug
cccucagcaccccucugccucagcaccccucugccucagcaccccucugccucagcaccccucugccucagugcuccugugugaccu
gucuuuucaacuagaaagucuagaacuguacagaccccagaguuggaggcggaaagggacacuaggccguggagccuccucu
guggggcuuuuugaccagaugagaacguaaggggcuccuccagcuaucccugggcauucaggugcuucaggaauugugaccu
uugcugagacccuggaugcugcagcaaacagacaucugcuuuagcagagggacagcuugucucugugcauccgcugguagg
auccuccacucugucccaauuagcuugcgcugcugcuggguucugaguguucucuuacaaaaugacaaagguuagggggcugg
agagauggcucaggggcuaagagcaccccauguggcaguuucaacugucuguaacuccguuccaggggggaucugacacc
cucacacggacaaacaugcaggcaaaacaccuauuggcauggaaaaugaaaauaaaugaccggguuagcugagaaaauuccuuu
ugagaguugcuuucuccagucccaggacugcucucuggaucuuccugcucaguccucgccucccuucccauauauaguau
uuaaggguuuuacuuuuuuuuugcguuuucaauuguuuuaauauaaugauuuucuugugugugcacauaguauaug
ggaguccuacaagggucuagagacaucgaugcucgauggagcuaggaguuacagaauggguuaugagccaccugaugaguuguggag
gaacuggauuauaagguccgcgugugaaagagcaguugcaugcucuuaaccacugagcaacuuccacgcggccccccccaguaauau
cgguauuuaaaaucucuauagcaaugcuacccaacccauguggagcuggggaugguggagguggccuaguccccccaacuucc
uggaaacauguagcaaaaguacagauugggguguccgggggaucagcauggcgaggggggugggugggugggaggguggggcugc
uuucucccgaggcuaccgugauagacaguguaccuugcguggcagccucuccacauuuccaggaugucagucucugcagac
guauggggggacgggggggaaggggauacaagagcauggguggccuggaauguacuccaggaagugacugguaaaa
gucagcagaucuccugggggauagagggggugggggcugaagcucugugggggguugccucucuucagcccugaccuguaacaggaa
ggcuggggguuggaggaacacaguucccccugucucgggggggacaugcuggacagcccuuccuagcuccccccggccccac
uggggugugggcugggucgucgacugacugugacugcuguuuugaccuggucucuucugcugagcuuugacucguugagauagcau
uuggggcugagggauuggggggagucuucguucuuugguccugacaccccgcuucuuguuucuaggccugccaccuggcuccccccc
accccccucccggccuaccaaguuuccuugcuucccuacugaccccuccuccucccuccuuugugucuucccucccucccag
agaaugcccguuuucaagcucaauauggaacaccagcaacgagcccagaccgcgugaccaccugaccgugaucccggcc
cuugaguucggcaagccuaccaaaggacccuggccagcccccgagacagcaccugccgccaccugccagacacuuccagcucagcac
cuucaauggacgggguacaccggagaguuuugacaccuuccucuaccagcugccggggggacgacccagccgugcuccucagcuugu
uccucugccuccuccacgucuuucuuccucaucucuucggccaccucccccgcuuuccggcgucuucaaguuugaggacuuccagg
uguacggcugcuacccgggcacccugagcggcccauuagaugagaccccuauccuccagcggcucugaguacuauggcaagucc
cugcucagcccccgcgcuccaaucuacaccaaacuuucagcgccgguuuucccugggagcgucauuugggccacuuucucccccc
cgagccagacuuauuggaaggccucugggggcauggacagaaggcaguugccuaaggcuucuucagggggcuuccgccaccuccaaccuu
cuucucuucagcuccuuccacugggccccagccccagccuggccccagaguucugaaauuguuccaccaccagccaccccacc
agcuugggggagggggggagagcuauuccauggccagcagcuuuucccccggcuuggcacccacucucccgaaccgugacauucccgg
cauucugacgcaccccgugaccuccaccaaguuccggacgcggggcuucgaggugggcgcgagggccgcguucggcaguucuuuggg
ugacaaugcuucgugucagcacuauggggguccgccaccugugaggggcugcaagggcuucuucaagguauuuguugguucu
ggggggacgaugauaucauguuggaggugggggguggaguggucauccgguggaucuguagugaccucuccugaggguuuc
uuuccccagcuugguucuguccugcaggacgagggacaggugugugccaucuuaagaggcugggacuuuuuauucagcagggcac
acacucucuuuauuuuuuuuuuugggcugcaguaaagcuggguugaaagggggcagaaggugugugugugguggugcugcaguggugcucagaaaca
gaaaaccuaguggggcagccucucggguucuccacagaacuugguguuucggcacuggaugaaaggacacaggcagaggguuug
guucuugcuggggggugggacuuugggaacaggcuguguguguuuguucccagucugggugccgcuuuggcnnnnccccaccucca
ncccuuagucccucuccucugcgccaggaaaagggcagguggacacaugcagacaccuguuagaacaggugucuggacggcc
guggggaguucuagaccuggucuuugggguucuggggugagcuucccuguguggugugaacagcuguuggcuuugguaggcuuucccagacucc
ucucugcgcucuccgggccuuccgcuuuucucuccuuccccuacauuccaaaauguuaaggaaaauagcuauugaacagagggcgcuuuugu
cugcgucggccacaggaucuggacggucccucccccugggcucuccacccccccccaaaccccaugcucugacagccuguuc
cguguccccccuuccuccagcgcacaguacagaaaagcgccaagucauuccuugccuggcaaacaaggauugcccguuggacaag
aggcggcggaaccgcugccgcaguucugccgcuuccagaaugugccuggcguguggggcaugguggaaggaaggugggugggugguggcaagau
ggugcccucggcauaggcgaccugaaaucuccguuuucugcuuccuggggguggggugacuagcgggcacccccaccacccacccuuccaccuuucca
gauuccagcccuaaaaugcagguaguagcuuccaccugcuuuucgggaaaggugggggggugaggagggccuugugggggucccca
ucauggucgaguucucugucucugacuucucuucagaagugggguguauagugugccccugaagacccuccuuccucccaggucuc
cuuucucaauacugcccgucucucugccuuguacggggacagacagccuaaaagggcggcggggggccggcuaccuucaaaaccc
aagcagccuccagaugccuccccuacccaaucuuucucacuuuccacuuccuggcacacauggcauccgggccuagcacacuuugg
auuggacuauuccaagguggcugauucuugccccccgcccuucugcccuugcccugaauacauaugcaaugccuuuugugccuguuagg
aaaggcucuccuccaggggcaaucacaggaaaacaagcauccucuauguacuggcuaguugagaaauaucauggaauggggug
uggggucgggggagcccaguuacaaacagcugccguagcccuguuuuccuuggggaaauugacaagcacaugggcccagaauag
ggcucuuuuugcaacgccuggaucuggugccgccugugauggaggccucagucgugacaacagugugugggugcaggcccucaugu
gaacuuaccugcguuccuuucagucccaggaacugugucugcccccgcuucgggaaggaagauggcggugacgugcaacaau
uuuuuaugacuugcucucuggguccuggacguuuauccgaaagugggcagaaaaauccccuggcuucauugagcuuugcccag
gagaccaagacccugugcuagagcucgcuuuccuggaaccucccgccuggcauaccgguaagcugcccaccuucc
uccuagccuggccccagcccugcgggccccggccugccuggaccccugagccugacuguucucucgccuucucgccagaucuaa
accccggugaggggaagcucauccucugcucaggcucgguacuacaccagcugcaugugcccgugguuuggugauuggau
ugacaacauccuggccuucucacguccccugcacagcuuggggugugauguucccgccuuugccugccugccugucgcucggu
cccaucacugguaggauggcagaaacuagcugggcccaagggguucggaccauuggguaggcacuuaacacacuuggg
ggaccccuagagugccugcaacauugggauguuaggaccugcaaagggacuuagcucuauucgcccuaaagcuuaaaucag
cccuccgaaugaccccggacucccucaggacggacguguaggcgcuggggcaucagcuuagggaauucguuuguuuaaaaaccu
agcugucaaccucaagacacaggaacgugcacacaugaauuuuucacauucugcgcuuggauagcuaucgccaugguccaa
gaaacaggacaacuucagcucuguugggcuccccuuuaaauugcucuguagaauaguagagguuucgcuccuuccuc
auccugcauggauuuuacuggugcgaucacaggguauggacucuaguguuaauguagaggguucugggugcccuucug
uuccgcuccauuccacuuaaauuucuuaggggauccuccugaguagaucaagaccaggacggaucuugaaagggug
ggagugauaucuacacccagcucaguccuuagucucuccugcgagacuccagggauuuuagaacaguguggagccggaccuc
cagaaaccuggauuaggcuuuugccuuggccagccauucaguggguucaaauauugaccagucggacaguggggcuccug
uggggacgugcuagagggcuggggaagcuugucagggagaaggcgucaacugagcggggcugacucuaccuucccugcugca

TABLE 3-continued

RNA transcripts up-regulated during HF stem cell activation.

SEQ
ID
No:Access. # Sequence gaucgacacgggcuccaggacccucgucggguggaagagcugcagaaucgcauugcuagcugucugaaggagcacauggcua
ccguggcaggagacccacagccggccagcugccugucacgucugcugggcaaacugccugagcuucggacccugugcacuca
aggccugcagcgcaucuuuugccucaaguuggaggacuuggaccccucccaccuauugugggacaagaucuuuauggacaca
uugucuuucugaccccugcccugaacaugugugcgcacacgugcgugcucuucugucacccaugugccuuuaagccuauag
cccacggacccccagaccacccuaccccagccugguuugagcuaagacugacguaccuccucacuccagaagauggacaga
gaacucaagaccugggggaggugguguauucacggggguggaccccacuauuugucuuuaucccuccagcucaguccggccu
ucgugugguuuuuguaagauaaaccauuuuuaaacacauaccacucuguugaaauaagcugacgcuacuguaaaaucagaaag
gaagagguugagauggggguugggaggaaggguggggcucccaccagcugggcgagccuccaacucgagaucucuuccgc
ucuccuuccaugugacauaacugucacucaagaaggugauugacagauucgauuuauauuugugauuuuuccuggauuu
auaggaugugacuuucugauuaauauauuuaauauauugaauaaaaaauagacauguaguugaaa 89 AF038562    ggcacgaggcugugcccgccaugucugcuacccaucacaagaccucccugccucagggcg
              uccgcgugggcacugucaugagaauucgaggcuuggucccugaccaggcuggcagguucc
              auguaaaccugcuaugcggugaggagcaaggagcagaugccgccuugcacuuuaacccga
              ggcuggacacuuccgagguugucuucaacaccaaacaacaaggcaaauggggccgugagg
              agcgaggcaccggcauccccuuccagcgugggcagcccuuugaagugcuccucaucgcca
              cagaggaaggcuucaaggcugugggcggggaugacgaauaucuccacuuccaccaccggc
              ugccgcccgcccgcguucgcuugguggaagugggcggagacgugcagcugcauucauuga
              auaucuucuaagcaaaggaccaagggccuuugcccgguacggguugggggguuuuuuga
              ucccacaagaaagguuuuggaucggccaauaacauuuuucuguuguucugaaaaauuaaa
              aaaaaaaaaaaaaaaaaaaaaaaaaaaaaaaaaaaaaaaaaaaa 90 Y11666      gccacauuguugcaccaacuccagugcuggagcucaggacaccaca
              ggcuacccggaguuguucugcuuuggagauccgagggcaggagcaucacgccagugacuc
              ugauaggugcgaucgccggauuggaacagaacugucauuuuuuuccgaaguugagccuua
              gugacccagugagugaaguuagcgacgggacgcuaagcagcuagaccggucggcaggagu
              gagacuuagggguaccuucuaguaguugugauuaaaaaaauugaaaaaagaaaaaaaaaa
              acccuguuucuggaaacuugaggcccucagcuggugagccaucguggguuaagcuucuuug
              uguggcuccuggagucuucgaucccagccggacacccgggccugguuucaaagcggucgg
              acagcgcugccugcuccaucgguagcgcucgagccucguuucucuauuuggccccgacu
              cgccgcaacaagaugaucgccucgcauugaucgccugcuuauucacggagcucaaccaa
              aaccaagugcaga 91 U40930     Sequence below.
cccagcuguuucgucccguaccuagaccgcgguuauggcgucguucacggugaaggccuaucuucugggcaaggaggagg
cgacccgcgagaucgccgcuucagcuucugcuucagcccgagccgggacggggaagccaagccgcggccggccccgggg
cccugcgagaggcugcugagccgagugcugugcuguucccacgccugaggccuggcggcuuccaggcgcacuaccgcg
augaggauggggacuuggugccuuuccagugaugaggagcugacaauggcuaugccuaugugaaagaugacaucu
uccgcaucuacauuaaagagaagaaggagugccggcgggaacaucgccaccaugugcucaggaggcaccccgaaacaug
gugcacccaaugugacucugugaugguugcaacgggccugugguggacucgcuauaagugcagugugggccccagacu
acgaccugcagcgugugcgagggaagggccugcacagggaacacagcaagcucaucuuucccaaccccuuuggccac
cucucugauagcuucucucauagccgcugguucggaagcugaaacauggacacuuuggcuggccuggcugggagaugg
gcccaccggggaacuggagcccacguccuccucgugcaggggauggccgcccuugcccuacagcugagcagcuucugcu
ccaccagaagauccaaugucaauuuccugaagaugucugggggagaguggcagcuccucagcccucuaggcauuga
gguugacauugaugugggaacauggagggaagagaagccgccugacacccacuaccccagaaaguuccagcacaggcacag
aagacaagaguaacacucagccaagcagcugcucuucggaagucagcaaaccugacggggcuggggagggcccugcucag
ucucugacagagcaaaugaaaaagauagccuuggagucgguggacagccagaggaacagauggagucgggaaacugcuc
aggaggagacgaugacuggacacauuugcucuucaaaagaagguggacccaaucaccagucaucuacagaguc
cagaaucggaagggccaagcucucuagaccccucacaggaaggaccacagggcugaaggaagcugcccuauacccacauc
ucccaccagaggcugauccccggcugauugagucccucucccagaugcuguccauggguuucucgaugaaggcggcug
gcucaccaggcuccuacagaccaagaauuacgacaucggggcugcucuggacacgauccaguauucgaagcacccuccacc
auuguugauaugucugugccaagcccaccccuuugucuuguaguugcaucacguagagcagcagggcuucuauagau
aggccagugucuuggcauucuuguagaaucuucagguggaaugugaaugcuuuucaggcaauaggaaaagugcau
gaggagaguuugaaugugcauagcugacgccugagaacagaccaggucccguggcugacugagcuuccucugcu
ucccuaggccuggccucugcagggaacugcagcacacacugcacucccaccugcucuugccgccagcauugcaccagca
guccagaauuccugccugacaacccguguuucccuuuauuaaagugauuaguacaacugcuaguuauuuucaacaaaua
aagccauuaugguuaagagggacugcccauagugaugaaagggcaggcuggccuacagccuccuaggaauggag
aauucaugugaagccgaauggaggaucuuaucuuauacugucccccuuucuaaaggccacucuuugguuugugucua
auguaaaugcuuaaagcacaggacccccaugagcuuccucgacuuggguuuguaaguaaccuguaauaaaaugccaua
ugcacuuuaacca 92 D26090      Sequence below.
gagggaaaugcgggaccccgucuggggaagcucccgccgccccgggugcucagcucucugucucccuugacccaggua
cagucaugucgggcuucgacgacccgggcauuuucuacagcgacagcuucggguggcgaccccggugcggaagagggcca
ggcccgcaagucgcaacugcagaggcgauucaaggagucgugacagaaaccugcgagguggccacgaucgcaggcuuca
ccuucaaguacagagaugaacucaagcggcauuacaaccugguugaauacuggaucgagguggaugggaaccuggcc
aguuuugacgaggaacuggcugaccacuugcauaaacagccggccgagcacuuacagcugcuugaggaagcugcaagga
gguggcagaugagguugaccggccccggccagcuggagaugagcugcuccaagacauccaggucaugcucaagucagaug
ccagcccgucgacaucggauucugaagcagacaugauguacaccggugaauuucgccgcacaacacccucaccaauaugccaugcc
ucugcagucccgugccaaggcuacucguaucuccauucagugccgcagcugccacaacaccccucaccauaugcccaugcc
caggccuagagggcuaugccuucccaggaagugcaauauggaucaggcugggcgcccaaagugcccacugauccauacu
ucaucaugccugacaagugcaagugugggacuuccagacucugaaacugcaggagcugccugaucaguccccaucugg
ugagaugcccaggcacaugcagcuuuauugugacagguaccugugugacaagguuguuccugggaacagggucaccauc
auggcauuuauuccaucaagaaguuuggcuugaaccccagcaagggccgggacaggguaggguggggcauccggagcu

TABLE 3-continued

RNA transcripts up-regulated during HF stem cell activation.

SEQ ID No: Access. # Sequence cguacauccgagugcugggcauccaggugg acacagauggcucuggccgaagcuuugcugggucugucagcccacagga
agaggaggaauuucgucgccuggcugccuccccaacauauaugagcucaucuccaagagcauuuccccucccaucuuug
ggggcauggauaugaagaaggccauugccugccugcuuuuuggggguucccggaagaggcucccagauggacucacucg
ccgaggugauaucaacuugcugauguggagacccugguacagccaagcucagcuucugaaguuugugagaagugc
ucucccauggggugacacaucugggaaaggu agcagugcugcaggcuugacugccucagugaucgggacccucau
cucgaaacuucaucauggaaggug gagccaugguucuggccgaugguggggu ugucuguauugaugaguuugacaaga
ugcgggaagaugaccguguugcaauccaug aggcuaug gagcagcagaccaucuccauu gcuaaagcugggaucacuacc
accuugaacucucgcugcucuguucuggcugcagccaacucagug uuuggccgauggg augagacaaaagggg aggaca
auauugacuucaug ccuaccaucuugucccgauuug auaug aucuucaucgucaaagaugagcacaaug aggagaggga
caugaug cuagccaaacaugugaugacucugcaugugagug cacugacacagacacaggcugu gg aggg ugag aucgac
cuggccaagaugaagaaguucauugccuacug ccgagcgaggg ugg gacc ucggcuaucagcagaggcagcag ag aagcu
g aagaaccgcuacaucaucaugcggaguggg cucgucagcaugagagggacagug accggcguuccagcaucccc auca
cugugcggcagcuggaggcuauugugcgcauugcugaggcccucag uaag aug aaacug cagcccuuugccacug aggc
ugauguag gagg aggcauugag acug uuccagguguccacacuggaug cugcuuu gucuggcaaucugucggggg ugga
gggcuucacuaccc aggaggaccaggagaugcugagccgcauuggagaagcaac ucaaggcccguuuugccauuggcucuc
aggugucugaacacagcauugucc aggacuucaccaaacagaaauauccagagcacgcuauccgaaaggugcugcagcuc
augcuacgcaggg ugagauccaacaccguaugcagcgcaaggugcucuaucgccucaagugagcccauugccaucaac
ccucaagccug aaaugcugccaccacccuaucucccagucagugcuccaaaccuccuuuugcccug ccucuccaccucaga
cugcugucugcagcacaucugcagccccug gaaaug uacuuugg cuguuggcucaucuguguuug agugucug agg
acucucugcucuggg ugucuauccccugucaugccuucucaacaag aug agucugg agcagg aacaggcccuggaaugu
agaug gggucuguauauuggcucccggg ccacucacugccaagcuucuu ug uauguacagagguaauaaagcaauug agu
cccuggcugcuaaggucag uggacccag u

| 93 | AI787627 | ggaugcagccggaagugcagcgugcgugcgguuuggugggucgcugugugcgcuccgcgu gugcagccgcugggccaugggg cggcgggcgcggggccggcgguccagcagccgccgc agccug agggcg agg aagacgccagcg acgcggcagaaagcg aggccaggcggg cuggg aagguggcuauccccg agaucguaaaggag aacaagcucuucg agcacuacuaucag gaac ucaagaucgugccagagggag aaugggaccaauucaug gagucacuccgagaaccucucc cagccacacug agaaucacuggguacaaaagccaugccaaagagauucuccauu gcuuga agaacaag uacuuu aaggaguuggagg anccug aag uag aug gacag aaaag uug aguucc acaaccacuaagcugguacccug aag aacu |
|---|---|---|
| 94 | M33988 | gagcucaaauucuggcuuucuauugggguacgauauauu aaccaaug gg agaaacacaaac agaauaccuccagu uag auaaaug cuugcug uucag uugcag aauuuacuauauauucu uuuccuuucucugcuuug ccuuuacug aauacuu aaacgcauacaug ucugg acg cgg aaa gcaagggugcaaggcccgcgcuaaggccaagacccgcucccuccccgggccggccugcaguu ccccgugggccgcugcaccggcugcuccgcaagggcaacuacucggagcgcgugggcgc cggcgcccggguguaccuggcggcugugcuggaguaccugacggccgagauccuggagcu ggcgggcaaugcggcccgcgacaacaagaagacgcgcaucauccc gcgccaccugcagcu ggccaucc gcaacgacgagg agcuc aacaag cug cuggg ccgcgug accaucgcgcaggg cggcguccugcccaacauccaggccgugcugcugcccaagaagaccg agagccaccacaa ggccaaggggaaguaaucuggcg auug ucuguacugcccagu ug aaag uuaaccaaaaca aaggcucuuuucagagccaccacaucuuuccauaaaaug ag cugccaccucgug aaacg uucuuccacuacagu uuuuauacuacauaug aaaaag uuacg aaguagcuuucaaucuua guaaauugauuuuaauacuguuaguccccugcgauaaaucuu acgaccuuccuuaguuuga gucaaaagugug uaagagaugaaaccuuuagaacauacuauaaauuuuuag uagaaauuu ggcacccagg uuu gucauuc acgucacgauuguucuag agcauaauggu ag uaagggcuaa gg gccauuaaauccc acuuccauaguuuc |
| 95 | AI845182 | uuuuuuuuuuuuuuuuuggaaaugaaggu aaauuauugaaacugguuuggg acaggcga gug gacaacguug aaaggag cuagcgcacagccggg uggg agcggg ugcuu agccacag auccuaucug aggccc aacuuuuucuuuuccuucugcuucuuacgaccac auccagguu ccgguccuuccacaugcuuuugcgaagcuug aug gggcugagcccacauacuucccauu caucucucgcaugg cgcgcacauag ucacugggg ucuuugaagcugacaaagccauagcc cuugguuuugccugugcgcuuguca |
| 96 | AA619207 | uucggauccuugccaauauaugu aucccauuuggaaugg ug aucuuaaaauguagagugca ugcauacuaucuuauuuaag auacuugcaccccaccc acucccaucuccc gaagcuggaa cacug ccaacu aggucc uu aagaaucacgcaauuaacacaagguuggg ugcugcuaauuc uucaug aaaauccaaacacguuaagggaccagggag aug ccacugccccccug aauuuuc aucaaaauagacacguuuuau gu aaacagaacuauuuuccauauucaug ug acuuuuua aguauuugacc uaaagauuuug aucuccauuuuu auaacuauuuaaauugu uc acaauu auuacau |
| 97 | AW125783 | cggccgccgccgccccacacugcccccgcguugacgagcgccgcgacggcaaggacagcg ccucgcuuuucguggugccuggaucucagcggacucaaccagcaggcgccggcgcccg cccccgcgaacgcagagaagggg ccgcugcgcgcaaggcgaggaccccc ugccgccugc cgccugcgccccc ugcgccgccaccggcccagagcccgccuccccgggacaagcaggcg cgccggccgcgccccc agccccgcgug gagcgagcggaggcggcauggagcaggagc ccggccccgcggg gagcggcg agccuggccucagacaaagggg ucgggg aggccgg agcc gcgcggaccucgagucccc gcagaggaag cacaagugccacuacgcgggg cugcg agaa |

TABLE 3-continued

RNA transcripts up-regulated during HF stem cell activation.

SEQ
ID
No: Access. # Sequence

98 J04103   Sequence below.
cgucaguccccgccaccucccggccccgcgcgcccggaucggcccuacggccucgucucgcccggccuugcgcgcgggacc
gccgcgaucuccucuccccgccgccuccggcuggcccugccugcugcggcgcgaugaaugacuuuggaaucaagaacaugg
accaaguggcccugucgccaacaguuuucguggacacucaagcgccagccagccuuugacaccuucgauggcucucuguu
ugcugugcucccuucucucagugaagaucagacacuccaagaagugcccacgggccuggauucugucucccaugacucggcc
agcugcgagcugccuuugcucacucccugcagcaaggcaguagaugagccaagccuuaaaagccaccuucaguggcuuccaaa
aggagcaacgacgucuuggcauccccaaaaaccccuggcuguggagcgagcagcagguguugccaguggcuucucuggggccac
caacgaguucagccuggugaaugugaaccugcaccaguuuggcaugaacggccagaugcuguguaaccucggcaaggagcgc
uuccuggagcuggcgccugacuuugugggugacauccucugggaacaucuagagcagaugaucaaagagaaccaagaaaaga
cagaagaccaauaugaggaaaaucucuaccucaacgcgguuccucauuggaucaacagcaauacauuaggcuucagcauggaa
caggcuccauauggaaugcaggcaccaaacuaccccaaagacaaucuccuggacagcaugugcccgccaucggccacgccugc
agcucugggcucugagcuccagaugauugcccaagucucggcucaacaccgucaaugucaauuacuguuccaucagccaggac
uuccccagcagcaacgugaauuugcucaacaacaauucuggaaaacccaaggaccacgacucuccagagaacgguggggacag
cuucgagagcuccgacucgcugcugagguccuggaacagccagucgucccuacuggaugaacagcggguaccuuccuucgag
agcuuugaggaggacuguagccagucucugugccucaguaagcugaccaugaccuucaaggacuacauccaagagaggagcg
acccagucgagcaaggcaaaccaguuauuccugcagcaguacuggcuggcuucacuggaagcggaccaauccaguuguggca
guuucuucuggagcuacucucugacaaguccugucaaucuuucaucagcuggacggggaugggauggagaguucaagcuugc
ugaccccgaugagguugcccgccguggggaagaggaaaaauaaaccaaagaugaacuacgagaagcugagccggggccuua
cguuacuacgacaagaacaucauccacagacuucgggcaagcgcuacguguaccguuucguaugugaccgcagaaucu
ugcugggcuucacuccggaggaacugcaugccaucucugggcgucagccugauacagaagacugagggccuca 99 D90146   Sequence below.
auggcucuaacaacgcugcucuuggugguggcggccgcccugacccugaucgagacccgcgcggugagugcgggucggg
agggaaacagccccugugccgcguccccgcuucgcccaccggaccuccgccccuucuccacccgagccccgagcccugcucca
cucccggcccgcguacccgaccggggucccggaggaggucgggucucaccgcgcgccgccccaggcccacacucgcugc
gguauuccacaccgcuguguccggcccggacucggggagcccccgguucaucaucgucggcuacguggacgacacgcaguu
cgugcguucgacagagacgcggaaaauccgaggauggagccgcgggcgcggugguggagcaggaggggccggaguauug
ggagcgggagacacagaucgccaagggccaugagcagaguuucaagggccugaggacugcacagagcuacuacaaccag
agcaagggcggugagugaccccgggucggaggucacuaccucuccacgucccgaaacagaggccggugaggucccgggugca
aaguccgagguucaggagcagaacugacccaggacuggauucccuuucaguuuggaggaguccgcgguggggggugggg
ggggcggaggagggacagcacuggguccgcaggcucucacacaccaguggaugauguauggcugugacaugggguccg
acgggcgccuccuccgcgggguaccugcaguucgccuaugaaggccgcgauuacaucgcccugaacgaagaccugaaaacgug
gacggcggcggacauggaggcacagaucaccgacgcaaguggagcaggcugguauugcagagagagaccgggccuaccug
gaggucgcgugaggcuccgcagauaccugcagcucgggaaggagacgcugcugcgcacaggugcagggggccgcgggcagcuc
cuccucugcccucaggcuggggccucagucugggagaagaaaacccucagcuggggugggaccucccuggcucagagggga
gagagugacccuggggucuccugauccucaucacagugacugcacugacucuccccagggcucagccuucucccuggacagug
cccaggcugucucaggaggggaaggagagaauuucccugagguaacaacagcugucccuucaguucccucuagccucuguc
agccauggccucucccaggccaggguucucagcccuacacccacugucuguagacacugacuccuguccugcugagugugca
gcccuuacaccucaaugaccugaagucuccuuuaccccgauggugacaggacaucuacaaggcugguuccccaguuucu
agaacuuuccaaagaauacagucuaccagauccuucccugucuguggggunugcauccuuugacacccaauucuaucuauuc
cugcaauggugaauagucacaugagccauuaugggguuacccuaaacaaauacuuuucuugguguuuuucccccucucguuuc
uuuuuuaucuuuacuuuuuuuuaaagggguauuauguugcuuauaaucgguuuuucuucggcacuggaaugauauugcucuc
ucucccaccauaccccccacccccgccuauaaucauuuguaucaguagcccugcugucguggaacucacucuguagaccagg
cuggccuugaacucagaaaucagccugcucucugucucugccucugccuccaagucugggauuaaaggcuuggggccaccac
cacugggcagaagaaagguuccugugagcuuaaaauguuuucggcagaauuaaccauccagaucacuccugauaucccugu
gccccaccaaguuacagugcuccccccugguguaaucagaacuuggacucugagagacagggucuuucugcaauccaggccugag
ugagagggaagaccacacaccugugagcccacuguguucagugaguugcugcacuggggguccacagcacauuccagggauc
cugugugacaucugaccuugucccccagagucagggcagggucuucucuguagugucagagguucacca
cauuucugcuacacacucccugauggcuguuuacuuggacugacaguuaaugugucagcaagaugaccacaguguuua
gucucaauggugucacucuccaguagcauaugguccugauuucuaauuuagauacgaacucaaacacauaugaaauuucu
uauuuuccauuccaucuuccauuauauagcuaccuaucgugcuauugaacaucacauaaggaugaccauguugacccacu
ggcucaauggaauccccuuuagcuuucugagucccucaggaaaaugucagccucugugcugaggggccagcucugccug
caggucacuagugccaugacaguuaaaguguucauacagacacauaguucauugaauuacugauuuagcguugucuuggc
aguuucaguuugcaugcauuuauuuauuuauuuauuuauuuauuuauuuaaugcauggaaguacacuguugcugu
acugauggucuguugccuuuguggguuguugggaauugaauuuuuuuuuuaggaccucucuuugcucuggucgaccc
ugcucacuccggucaacuccuuagggucaacucugcucauucaguccccugcuuguucuggcccaaagauuuauuuauuauu
uauuauacauaaauacacuguagcugacuucagaugcaccagaagagggcgucagaucucauucagauggguugugagccac
caugugguugcuggaguuugaacucaggaccuucaaaagagcagucagugcucuuacccucugagccaucucccccaguccuc
aguuugcucucuuaauugugcgauuucuugaaucuuccaaacagaucccccaaagacacaugugacccaucaccccauaucu
uaugaugcugucaccccuaggggucugggccugggccuuacccuguugacaacuuggcaguuggcaguugaauggggag
gagcugaccccaggacacggagcuuggagacaggccgcaggggauggaaccuuccagaaguggggcagcugugaugguug
ccuuuugggggagcagaauuacacaugccaugugccaugagggggcugccugagccccucaccccugagauggguaagg
aggguguggugcagagcugugucagggaaagcuggagcauucugcagacucugagcuggucagggcugagagcuggga
ucaugacccucaccuucauuuccuguaccugucucccagagccucccuacacagcucucaacauggcccaacauggcgaccauugcu
auuggguugaccuuggagcuguggccaucauuggagcugggccuuuugaugaauaggaggugaaacacagguag
gaaagggcagggucugagauucucucagucuccuuuagaagugugcucuaaucauuaaugggaaacccaucuacaccccac
auugcuaccuucuccaacuggguccucugucaguucgggaacuuccaagaucuuccuugaacucucacagcuuuccuucu
cacaggauggcaaggaggggaacugguguccagcuccagguuagguugggaguugccuguggacauuugcagagag
cuggagauguugggaagcucugggaacccauaguaacucuuccagagaaaucuuccagggcgcguuguccaauaugaaua
cauauauguaacauaugcauauacauuuuuaccuuggcagggacagcuccuagagcucgauagaucucucccaggugu
aaaggugacacucgggaccugaugggggaggggcaauguggauaugauuggguuucagggacuccacgaaucccccucuga
gugaguggugggguguuggaauguugucuucacagugaugggucgugucccuc TABLE 3-continued RNA transcripts up-regulated during HF stem cell activation.

SEQ
ID
No:Access. # Sequence

100 AI563854  uuaaaucuggagggauuuuucacacagccuaucuuuuuaggugugccuuucccauauuuu
auuaaaacucgaguuguuguuuuaaaaaaacagcagcauuaucaaagacacaucuguacaa
acauuuuacaaaagagaacucucuaggaucagcuacaucaaggacaagcagaaaaauaga
ugcaguccaacaaagacauugaaaaugacuu 101 AF017128 Sequence below.
ggucgcuuucugucuguagaggcggcuugccaccccgagcagaggggucgugaaguuccgaccggaccgguccacagaggu
ucaucuggagaggugggucccucccgaggugaaaggcgccgcugagaaacgccccccaccccgugguucaagugguuca
gcccaagaacuuuucauucauaaaaaagaccagacuccgagaggcgcgagugagucagaaccgcagccgccaacgcggacc
cuaccgaacauccagcccagggcauguaccgagacuacggggaaccgggaccgagcuccggggcuggcagcccguacggu
cgccccgcgcagccccccgcaagcucaggcacagaccgcccagcagcaggugagacuggccgaaucgucgggggggggggg
accugaguuuggacagcaucagggaugcugggauuagucuaguuugcucccgggauuggacuggggcccccgagcagcau
cugacucuggugucgcgaccgaggauccugcacguucuguguggucggggaaccuauguacccgguggccaaggggac
gagcgcagcgggaagcgcgaauaucugcgaauucccccuucucgcucgcccguaucucccuagcugacugucuuucugccc
cuccgucuccguuacggucuuaacauuuccuccuaucugcccccuaaauacgcuguccucuaaauaccugccccauccugc
cuggacaggaucagagggguguucuccaucuccaguuaauaacggggaccugggggucuggggcacauagagacggggguccau
cagaacucagccgggacagagaauucuuagcagccugucccgaggcuguccgugugguugcucugguugccgugucccuu
uauccggucaaguccucaucucuuugugcgcaguauagagcccauggggcccccaggcaguggguuccgagggguuccugga
gaccacgaagugguuggggaugugcgcgggggucaccugccggccacacucgcgcucccacauucuccggcaccccgacgucucu
cacugcuggauaggggggcacuugagagguugcaggugugguccauuucccgucgaggggcgcgagcacgugucgccagggga
gggaaggagcugcguccguuucgccgagucacagcggggccgagcacugaggcugagucacccuggggugccccccccuu
ccuggcccccaaacggccccuaaggaccgacgaccuggagcgagagaugcccccuggcagugcuucuagcccagaacgggg
gucacugagaugcuggggucccccaguauugggcuggggacauagcugucagacauugccagcauugagaggugcuucc
uggacuggaggggccccccacauccuuuagcucacagagcuuggaaccccaguuuucucuccagaacgcugagccccccacccca
ccgacacucaauccccaacacauggccucagauuucugcaagaaaaggaaggaaaggaugccagacccccuuauaggaggcuuu
uacucucuucacuuuauuucauggacuuaaaaaaccccaucaauuuugaacuuucaaguuuuuaagucgacagcuaggca
ugcauuuaauccccagcauucaggaggcagaggcaggcagaucucugggagggguugaagccaauuugcucuacaaagugac
uuccaggucagcuagagcuacauaaauagagaucgccugucucaaaacuuaaaaaaauaaaaacaaaaacaaaagccgauuaaaa
acucugauuucugagcuaugagagcuggccuucucaacagcaauggaacguugaaugauguuaauaacagggaaacugag
acuaaauaacaugccccagucucaaagcccaucaauuggccaagcuccaagcugaugcuggacucccaagcucuggugcuac
augucuauagucuugguugcccugggagguagaggcagaggaaucgugaguuuaggucuagccugagcuaugugagaucc
ugcccacccccaccccccggcccccucugcgagcaguuaagcaauuugcccguuggggaggcuagaagcugaaagu
augcccaucugugaggacugggucucaaaucuuaguuucuacuuacuagcugugggucuauggcaacugcucuccgu
cugaaaacaggauuaauggcagcuguggugaagucacuauuguuaaauaguuggaacagguguaaacgcaguccauacuugau
uuaaaacaaaaaaccaaacuaucucuggugggaaacagacagacgaagagagacauuuugugaccugcccaaaaucacac
agcuccugaacaaguaaguuucuggguugccaaaguggguguaucuacacguggacugag
aggagacagaaguccagccucucuguccccgggaagccccucaguccacacagaccuuauucauuucccuucuuaucucuca
gaaguuccaccuuugugccaagcaucgacagcagcagccaggaacugcacuggauggugcagccucauuccugggaccca
cuggcuauccccgaccucuggccuauccccaguacaguccccccucagccccggccaggagucauacgagcccuagggccac
cuccgggggugcgucgcaggcccugcgagcagguaaagaacagcgaugauuucacuuuccauagccuguaggggguccuuac
uagacagggacaggaucuugcuacgagggggaauuucuuauucagcauuugaaguuccugagaggccaagaaggagguaaaa
ggucaccuuugagucaaggaaggcuuccuggagaaggcuacacguuaaccuaaaccacggauaggauuugcguauggaa
gcugaaaagaaucuucggggaggagggguugaggcacagaauugaggugaaggggacagaguguuaagugagcaugucu
ccacugucugacgugcacagggugaaggaagccugaagcucggcuuuugaccucgggggacacagcuggggggacagaguc
acggaaucucagccuauuucuuuuaauuaucacaaaaagugagugggcagugggggcucacaccuuaaauuuucagcacug
ggggaggcagaggcagguggaucucugggguucaaggccagccuggguuuacagagugaguuccaggacagcaaggcuaca
gagaaacccugucucaagaaagggaaaaaaaagugaauggggaaauguauuucaauuuuuccaucuuccaucagaggaag
ugaagcauagagggggguacucacuugguccagaauucauacaaaaugugagauugagacaggacaggcuggguuaagggagguc
uacucaaucccaaagucagagcuuaaugagccacugucucaaugggagcucacagaagccugcagagggagugagcuga
gaacuuuugccucccugaaugccuuucuaaaauaaagaagggugguguuuuguugguuuguagaggugggguucuugag
agccuccugccuucccaagugcuaggaguauaggugugauuguuggugcccaggcaucuaguauuaggccaua
gcacuuucuuucccucccccugaaguacugagacugagucuagugcagggaggccuccauauacaaaaagcuggggguguacccc
guaauccccagaacucggaaaaucaagacaggaggagccauucagacgcuccaauggagacaggacuugguaaggucagcc
ugggauauauaaaacccuaucuuccgauaaccaaacaacaaucaaagcaaaccugacuuaagcugucuaaguaaggaagaauaug
cuguaagucaucagccuggcuggggggacugaccgccucugagggacugaagaaccugcuucaagcccggagccugcacu
caaccccuaguggaugcacacacagauccuugccaugauggcucgaagaggggauggcaagacccuggggagauauguugaga
uuggccagagaagagccagccagcaaggcuucccagcaaggggacuucucugugaacgagcuguggcagaagagag
gcaagcccagggugaauccuucccuuuagcccugggucccgagggagacacccuuugaccacgggguacuagguggguugagcu
gugagcuggggguagguggcuucccccgugugucucuggaacuugaacaaaucacucauccuccugagcuccucac
augugagugugucagagaucggauggggugacucagccagcggcucuggcugucccuuagaggaaucccgggguuccaaucauca
gcacccacgugggcaacucacugucccacaacgucccccaaaggucucuucuggccuccaccagcacugaaugc
acaaggugucuacaaacacacaggcaaaauacucagagguaaauuugucuuuuuuuccuuuuuugagacagggguuucu
cuguauagcccuggcuguccuagaacucacuuacagaccaggcuggccucaaacucacagagggcaucugccugcaccucccc
aaguguuugggaccaaagauguaugccaucacuauaagccuuuuuuuuuuguaaauuuuauuuaugaaugaagucuuc
cauguauaccuucaugccaggagggcaucagauccuuauugaggugguagcuggcaccgcuggguggcucuguggagaugu
uacuaggaccucuggaaagaggagcucuuuaaacugcuaaaacaucucucuagcccccagucuacauauuuuaaaaucuuuuuu
uaagauuguuuauuuauuauaucauaaguacauugugcuguucagacaucucagaagaggggcgucgaucucuguua
uggaugauugugagccaccauguggugucugggauuugaacucaggaccuuggaagaguagucaaugcucuuacccgc
ugacaucacagccccuuuuuaaaucuuuaaaaaaaaagggggggcuggagaugaucgucgcuguuaagag
cacugaaugcuuuucagaggguccugaguucaauuccccaacaaccuggacgugagcucacaacccaugcuaaauggguugaaucca
augcccucuucggguguaucugaagacagcaagggucuacucacauauguuaaauaaauaaauaaaauuuaaaagccag
guggguguuggguucagacagcagaucucuguuuaaggccagccuggucugaucuacaaaccaaguccaggacagccagg
gcuacacagagaaacccucuaaaaaaccaaucuauguaggggguggcuggugaaauggcucccggggguaaagguacuugcu
gcgaaauuaauggaccugaguucaauccuugaaauccacacaguagaaggagagaaccaacccucaaggggugcuaugacaca TABLE 3-continued RNA transcripts up-regulated during HF stem cell activation.

SEQ
ID
No:Access. # Sequence cacacacacacacacacacacacacacacacacacacacacacacacgacuauauauaugaauauaugacucuagccaggca
uaguguggcacaugccuuuaaucacaguacuugggaggcagaggcaggugaaguuugaggccagccuacagagugaauu
ccaugacagcuagaacuaugaaugaacccugucuuuaaaaacaacagcaacauaaagaaucuauguagggaagcuggaa
gggaugcugauacagucugcaauccuauuacucuagagguggaagccaaagaaucagggguuucaggccggucuugccu
auacacugagcuaaaggccagccugggacacaugagacuuugucucuuuuaaaaagacaaaacaagggggguugguuagau
ggcucagugagguaagagcacccaacugcucuuucugcagguccgaaguucaaauccagcaaccacaugguggcucacaac
caucuguaacgaaaucugagucccucuucuggagugucugaaaacaacuacaguguacuuacauauaauaaaaaauaaaua
aaucuuaaaaaaaaaaaaaaagacaaaacaagccagaugaggucugugaguuccaggccagccuggucuauaaaucaagu
ucaaggccaggcagggcuacucagagauucugucuaaaauacaaagaaacaaaacuacaaaaagcagaaaaaggaaucuac
gaaagggcuggugaaggggguguaacucagugguagagcauuugccgagcuagcauguaccaagccaugggguuugauccc
uagcacuaagcaaaagaaaaguccuacaaagggcuuuguuggcauaguagauuugaucccagugcuuuuggcacucaag
agcaccuucuacaauucacagcuccuggggggaagaaauccccaucuucacagaugaggaggcugagagucccugugaaaag
agauaaucaugucauacacucaggagagaaggcuacuucgccugagaaaugaaaaggcuuccugggguccccaacauc
uuaguccaguccuaagaugcggaagggaggaagaucaaaguuuacagagagggaaagcauuucaggaaagaaaccagcag
uaaagcuagggugugugagcuggaaaugucaccaaugagaugacaaggcguccgguacagagaagcaacugugagugu
ugggguguggcaccuagacuacagacugaaggaaagcuggaugaccagcucagggcagcuggugggcucagagucagccu
cauugucucccuucuucuauccaaccuagaucagcccagaggaggaagagcgccgcagggugagacgcgagcggaacaa
gcuagcagcugcuaagugcagaaaccgaagaaaggagcugacagacuuccugcaggcggugagcaucauccccaggcccg
gacccacagagccccaagagggucucggcucccaagaacacaaaagacccaaaauuacuccucaggacucuguccauccuc
ccugccugugggggaaguccuggaaaaggauaaggaaaguggcuuaaauauugguuugcgggcuucgaggcagagucg
aagaugguaggcagcaauucuccuaagaugccccccgucugaugggagucauggccauuucuccecagaggcucacggga
gggaguugcaguccagacuuguuggggaugacaggcacaguccucuaccecagccugaggcuugggggaucuuuuagccuuc
auuuccuaucuuucugcuaaauccuguaaaggagaccgacaaauuggaggaugagaaaucggggcugcagcgagagauu
gaagagcugcagaagcagaaggaacgccuugagcuggucuggaagcccaucgccccaucucgcaaaauccccagaaggaga
caagaaggacccaggugguucuggcagcaccagcggugcuagcagcccaccagcccccggccgcccagugccuugcaucu
cccuuucuccaggacccguacuugaaccggaagcacugcauaccccacgcucaugaccacaccucucugacuccuuuua
cuccgagucugguuuucaccuauccuagcacaccagaaccuugucccuccgcucaccgaaagaguagcagcagcaggguggc
gaccccuccuccgaccccccuggcgucucucuacacucuggcuuuguaggcaccccagccacaucccuugcuggugcuacu
ccaagccaucccccuuucucccaugauccagcaggccuggaccauacccuugccccaaaccagcagaucuuuuaucucuuc
cgacuagaacaaacacauuaugcuuugaugagcuagcuuggaggggauccccaaagcugcucacuguuuuucuagag
cuggccuaucauaauuugcacaaaauuagaggaaaauauguucccucugccagagaacgccuggcagcccagacuuugua
gaucccaggggucuuugacacccuuaccccuugcagaccacuuuccacgucacuuucuucaguguaauccagc
cuacucuacaccuagacagaaggugcccuuugacuagccuagaacacuaacucacacagcaucaacagccagcagcaccgg
acaucucugcaggcuccuccugaauggcacaacgcaggaggcgccaggggcuucuguggaggcggagcugcacucccuag
cucugagaagcgcuuagcuucagggugauccgagccuccaccgcaagggcagcugcuauuuauuuuccuaaagagacuauuuuuaua
caaaccuuccaaaauggaauaaaaggcuug 102 X67644    Sequence below.
ccgugggguuccuaauggugcuauugacgacgggcacaaagucucauaauuuuagaaacuucacuuauuuugugacccaccu
aguauggggcaaaggcaggagcuucggacuuccugucuuccucuauccuucugguccucucgggaguguccccuaagu
aaccauugcaguuuuguguccgugugcucuguugaaaucucugugaugugugauggguuuucacgugaacggaggcaggc
agagcccggucugugggguucuagugugucuuuaucuucuuggaaguuugugcaaugacuucccuccucuguuccugcgca
uaccuccaaguaaguacgugaaugguguuuucugugguccccuugaucuugcuggacuucacuaaggagggugggcuggaccau
cugcuacgugucugagagccccucucuagcuaccuacaugccggacgugagcuuacuccacaauguuuacccacaagcauu
cacuacucccaggaaagaacgugcacuggggcaccuagagaauaaccaaucaacgcuccgccuacauuuugcuuccuccuug
gaauuuccagccccuugcagcaacugcuccccagcugcgaagggcggaguuccccccgccccggccccuucuuuggcucua
uaaguagcucugcuuugcggggauuugcacuccucuacacucucugcacaacgucaaauuaugugccacucgcgcaacca
ucuccacaccaugacuggccugagggccccuucucecagcucccucaccggcccggaacuccggcggggcucugguccccgaa
auuuucaccuucgacccucucccggagcgggccgggccguggugucaccgcgcguggaacacuucucgcgggcaccgaaaacgca
gccgaagggugcucuacccucgagugguaguaucgcccgagugggcaucaggaggucgcgucgcccuggaacuuguaggu
aacaacuaggagcagggaccuucgaucugacguuccucuuuuaucugcucaggucggcgccagcuaccaaccgaggaac
ccaacauugccaagagggucucuuuccucuguucgccaucaucuucugccagauuuugauggcugaagaggugugucgc
agcccuggcucggaggaugcuaccagcgccgugacaccugaccccauuucugccauuacugcgccccggucccuga
gccuuugaaccugaccucggaguccucgacuaugcgcuggaucuuaaagcuuuucucuagcaacauccggcggccuucuaa
acgcgauggguucacaguccgaagaaacaaaggcaccaugggauggguaccugguguguagagaacguaucccaaacugggauuu
cuaaggcaacgcuaacucagaacacuaccgccaagagacaccgcgggguccuggcuaggcccacugggggacggacagagacuuu
cuccggucuaauuaaauuuuauguauuuaugugauauaucuucuagguaggaaggggguaaauuuauuucuaacu
uaugcaggggugcgagauaugccucccugcuguaacacagauauuuauuacgauuuuauagggucgguaagacagagugug
ggaggaggacccggggguaggacucccagcuuggggauuagucugggggggguguaauaagauuagggguaacacuccg
ucuuccagcacuucaacucuguagucuguuaaggcuuuggaagacccuugggaauccggccuuugaugucuucgguug
cuucucagggcagcugcaggagucuugggguccauggauugucagagggcggcugucuggggucgccuaguauguauguu
cugugaacacgaauaaacuugauuugccugucauuauaucugcaguucucgaaguguaucauucag 103 AF064088   See above (same Accession Number).

104 AI843085   uuuuuuuuuuuuuuuaaauugccgaauuaaguucuuuuaauagauugcauauauagau
              guuuagccauacucuagaucaacucuuuaagaguagaauuuuauauccaauuuacaugcu
              ucagauaucaccucuguuuguuacauaaggucuuguauccaaaugccacuugacacug
              agagcuuuaggaacaaaaaaggacacagagagaguugccauuuuuagcagcaaugaaaca
              ucacuaaccccuuuuuacauaccgaauucaagucacuac 105 AW124932   cggccgccgguauuuuuuugcaaguauugagaguucguauguuugaaaagaguaauuu
              uaacguuugggugccaagaaguggguuuucucagaguccauugccggcaaugggcaagcc
              uggcgguacuccucgugccgaau TABLE 3-continued RNA transcripts up-regulated during HF stem cell activation.

SEQ
ID
No: Access. # Sequence

106 X58609  augg
cgcugggaacgcugcuccugcugcuggcggccgcccuggcccggacccagaaccgagccg
gugagugcaggucggagggaaacagaacuuuccaaacagucugcggggaggggcgggu
gcggcaccggggaagccgcgugcccgcgucgccaccagacccuccgucucuuuaccccgc
gucccuagcccccgcgcccugcuccccuccugucccgcgcauccgcccggggucccgggag
aaggucgggucucaccgcgcgccgccccccaggcucacacucgaugcgguauuucgagac
cgucgugucccggccgggccucggggagccccgguacgucucugucggcuacguggacga
cacggaguucgugcgcuucgacagcgacgcggagaaaccgagguaugagccgcgggcgcg
guggauggagcaggaggggccggaguauugggagcggaucacgcagaucgccaagggcca
ugagcaguggguuccgagugagccugaggaaacugcuaggcuacuacaaccagagcgcggg
cggugaguugacccgggucggaggucaggcccccuccacuucccgacacagggacgcugac
guccugguucccaagucugagguucgggaacagaacggacccgggaccgguuucccuuuc
aguuuggaggaguccgcggguugggcggggcugaccgcggggucccgcagguucucacaca
cuccaggagauguauggcugugaugugggaucggacgggcgcucucuccgcggguaccgg
caguccgccuaugauggcugcgauuacauugcccgaacgaagaccugaaaaccuggacu
gcgaaggauguggcagcgcugaucaccagacgcaagugggagcaggauggugcugcagag
uauuacaaggcuuacauggagggcgagugcgugcagucgccucgcagauaccuggagcuc
ggggaaggagacgcugcugcgcacag 107 M18837  Sequence below.
auggcgucaacaaugcugcuucugcugguggcagucgcccagacccugaucgagauccgcgcgggugaguaccgggguccgg
agggaaauggccucugaggaaggggagggggcggcacgggggaagccgcgucccggcgucgccccaccugacccuccgcccc
uucuccaccccuagccccgccgcccugcuccccuccccggccgcgcuaccccgcgggggucccggaaggaguucggggucucaccg
cgcccugccuccaggcccacacuugcugaguuauuucuacaccuccgucccggccgggccuuggggagccccgguucauc
ucugucgguuacguggacaacacggaguucgugcgcuucgacagcgacgcggagaauccgagauaugagccgcgggcaccgu
ggauggagcaggaggggccggaguauugggagcggaaacacagaaagcaagggcaaugagcagauuuccgagugaaccu
gaggaccugcucagcuacuacaaccagacgcggcgguagaggaaggaaggaggacgcccucccacgguccccaaa
acaggggcccgagacguccgggccccaagucugagguucugagcagaacggacgcgggacugguucccuucaguuugg
aggagccgcgggugggcggggccgggcguggcggggccugaccgcggggucccgcaggcucucacacuauucagguga
ucucuggcugugaagugggguccgacgggcgccuccuccgcgggguaccagcaguucgccuacgacggccgcgauuacaucgc
ccugaacgaagaccugaaaaccugagaacggugcugcugggaccaaguggggagcaggauguggcaggcuggugcu
acagagaaaagcaaggccuaccuggaggggcgcgugcugcagucccucccgcagauaccuggagcucgggaaggagacgcugc
ugcgcacaggugcagggggccgcgggcagccuccuccccucgccccugggcuggggcucagucccuggggaagaagaaacccuca
gcuggggugaugccccugcucagaggggagagagugacccuggucuccugauccccucaucacagugacugcacugacucucc
cagggcucagccuucuccuggacagugccaggcugucucaggagggaaggagagaaauuccugaggaauaacagcug
ucccuucaguucccccuguagcucucugucagccauggccucucccaggccggguucucagcccacugucguagacacugacu
ccugucccugcugagugugucagcccuuacaccucaggaccagaagucgccuuuaacugaucggagacauggacuacccuaca
cuaggcugauugccucaguuuccugaauuuucaaaagaauacauucucccagaucccuccccugucugugggguuuccacccc
uucgacaaccuaaaucucuauuccuauaggguggccaucagccucccuggaggaauaucaauagug
gaauuucuucuucuucuucuucuucuucuucuucuucuucuucuucuucuucuucuucuucuucuucuucuucuucu
ucuucuucuucuucuucuucucucucucucucucucucucucucucucucucucucucucucucucucucucucucucucuc
ucuucuucaguuuuugagauagggguuucucuguaugcccuggcugucccuggaacucacuuguagaccaggauggccucgac
cucagaaauccgccugccucugccucccagugcugggauuaaaggcgugugccaccugcccagccuuucuuauuuucuu
uacuuuuuuuuuuuggagggggguaauuuugguucuagucaucuuuugucuuuugucugcacuggagugauccug
uuucucccugcccuuauauuaucaugugauucagucuccacaggugccagggaaguuaagacaaguuaaaucagggguucuc
uuuaagggagaggauuccugugaacuuagacuguuccugucagaacuaaacauccagaagccuccugcucuuccucuguccc
acaaguuacagugcucccccccccccccagugcaucggacuuggacucugagagacaggggucuucgcaauccagggcug
gagugagagggaagaccacacaccccugagcccacugugugcagugagugcagcugggguccacgcauacuccaggg
auccugugacacaccccuguacccuugccccccagagucaggggcuggaagucauuuucucuggcugagugucagagguuga
caccauuucugcuacacacucugugauggcugcucacuuggacuggcgguuaugcuaguuagcaagaugaacacagugguu
uacgucucaguggucacacccuuccaguggcauauggcucuaauuucuacuuuugauacgaacucaaacacuuauuaaauua
guuaguuccauuccaucuuccauucuaguccauucaugcuaaagaacacauaaggacugcauaaggacgucccaguggcu
caugugggauccccucuuagcuucugaguccccagaaaaaugugcagcugaggaaaccagcucugccugcaggucaccagug
ccaugacaguugaagugucaaacagacacauuguucagugcaucagugauuaacugugccuugucuagauuucagaggg
ucuuguuaauugugguacuuuuuuuuguuuuuuguuuagguuuuuuuuuguuuuguuuucaagacaggauuuuucugu
auagcccuggcugccuggaacucacauugguggaccaggcugcuacacagaacucagagaaaucugccugccucuguggccucccgagu
gcugggauuaaaggcgugugccaccaccaaccagcuaacgugagauuucucuuuuuucuuuucuuuucuucuuuuuu
uuuuuuuuugugugugugugguuuuuguuuuuugagacagggguucucuguguaucccuggcugccuugaacucacuug
uagaccaggcuggccuugaacuuagaaauuugccugccucugcucggagugcugggauuaaaggcaugugccacuaccaac
cagcuaaauuggauguuccucaaacagaucucccacacagcauggcagcaugcacaugagacaugcugguga
ugucacccugagggucugggcccugggcuucuacccugcuaacaucauccugacuggcaguugaauggaggagcugac
ccaggacauggagcuuguggagaccaggccuuucagggggauggaaccuucagaagugggcaucgugggugugcucuugg
gaaggagcagaauuacacaugccauguucaccaugagggggucugccugagccccucacccugaugggguaaggaggugug
ggugcagagcugggggucagggaaagcuggggcuuuugcagaccccugagcguccugaucugagagcugggacgaccau
caccuucauuucuguaccugcucccuccccagagcccuccuccauccacugucuccaacaauggcgaacuagcuguucgggug
uccuuggagcuuggccaucaugcagcugugggcucuuuugaugaagagaaggagacacacaggauuaaggggcgag
ucugaguuucucucagccuccuuuagagugugcucugcucaucaauggggaacacaggcacaccccacauugcuacugucu
guaacgucucacagucuggaacucucaguguguccaagcucacucacacagcuuuuccuucuucacagg
uggacaaggagggacuaugcugucugccucagguugugugggagacagaguugcccugaggucauuggagugaagcagg
aguguugggugcucugggaacccauaauagcuucucguuuaaucucugugggcccugucagaucuugcuauagau
auaucuuuguuauauuuuuccuaggcagggacagcucccagagcucgauauguucucucaagauuguaaaaggugaca
uucuauggccugauugcagaggggcacuggggacauuuguuucagggacucccacaaucccccugugagggggu
uguugggauauugucuucauuguggugguuccugaccccucauucucuaucaugaagacagcugccuggagugggacuuagu

TABLE 3-continued

RNA transcripts up-regulated during HF stem cell activation.

SEQ
ID
No:Access. # Sequence gacagccagugugaccuugggucuucauuuuucuuuagagaacagcgccugauguucccugugagccuaugggcucaaugu
gaagaauuguggagcccagccuucgccuacacaccaggaccugucucuugcauugcccuguguuccuuccaccgccaaccu
uccggguctugcag 108 AW124268  uuuuuuuuuuuuuuuucagaauaaauugcagacaaauuccauuuauuuuucuaaaaaccu
cauuaucuaaaauuuauacagccucacauuccuaaaccaccucuggcacuuuucuugaau
uaagucaaggcguacacagcuccgaaagaaaaauagagaauccgguuccaggaagauggcc
augaggacucgcagauaugucuccucggaccuggaagcgugucagccaugggauccacua
auccaccauccgguacacagggucacccacucucaggcucccaagcuucuccaccgagaa
auacaucccaaaaaguggagaugacugguauauacucuucacagaaggaucacacaggcg
auagcucuucagggucuccaguggc 109 AF090738  Sequence below.
cucuagaugaauacacucucaugagggccaccuucucuggaguucaggucgccucugcccauccuucccugcguccucuc c
caaaguggccuacaaccccuuacccagaggacuauggagacauuggagauugguucucacaagaguuccagcaguaaccugggg
gcagaugauggcuacaugcccaugaccccuggggcagcccuuaaggaguggugucccaauagcucaagagcgaugacuaca
ugcccaugagccccacaagcgugucugucucccaagcagauccugcagccacgcuuggcagcggccuugccccccuuccggagc
agccgugccagcaccccuucaggggugggcaggaccuucccaguaaacggagguggcuacaaagccagcuccccagcggag
agcuccccagaagacagugggguacaugcgaauggguguggcccaagcugucaagggguggaaccagaccccuaagcuacucc
ccaacgggacuacucaacaugucccccagcgaggcaggcacugcagggaccccaccuggacuuucucagcagcuuugcgugg
aggcagugaaggccucaaaaggcaucccggggccacugcuacagcucuuugcccgcucuuauaaggcuccugucucgcagc
ggagacaaugaccaguaugugcucaugagcucccccuguggccgggaucuuggaagaggagagacuggagccccaggccaccc
cagggggcuggcaccuuugggggcagcuggugggauggccagcgauguggggcagugcggccuacacgccuaucgcuagagggacu
ugccaucgguggccgcccugaggggcuuccugggccagccgaaugagcgucccaauggaggccuucucucucc
agaggcuucaucucccauacccaccacugccccccacgcucuuccacuuccccuuccuccuacagcagcccucugccaccugcc
cgggagaccuauaccgccugccuccagcaucagcugccacuuccagggucccacugcuggcuccucaaugucccuccgagcc
ugggauaauggcugacuauaaccgagauggccuuugguguggcugcaaccccgccacaacccuaucguggccaccuccaaagcca
gaaggugcccgaguggccaguccacaucgggcuugaagcggcuaagucucauggaucaggauucuggggguggaggcuuuc
cuucaagucagccagcccccugaccccaccggggugcuaaggucauccgugcagacccacaggggggacgucgucgccacag
uucagagaccuuucccucuaccacaccgucaccccagugucccauccuuugcccacaauuccaagcgccacaauuccggcu
cuguggaaaugcucacucaggaaaagcagugaaggcagcaguaccugggaggaggugaugagccgcccacaucccagg
acaggcacagccuuggugggcugugccccagugccacaggcuagcgguggaaccccggacgcccggagcuuugauuggc
ugccuggaggcagcaguucucccaugcgcagagagaccuccgugggguuuccagaacggccucaacuauauccgccaucgaug
ugagaggcgagcaggggguccuuggcgcagucucagccgcagccaggagacaagaacuccuggagccggacccguagccuugg
ggggcuccucgcgaccgucggaggcucuggcgccagcggagugugggggguccaggcacuggagcuuugcccucugccag
caccuaugcaagcaucgacuuccuguccecucaacuugaaggaagccacagucgugaaaggugaggcccuuugaccuuqaqga
uggggagggagaguggaguauugggguggcu 110 AI834950  uuuuuuuuuuuuuuuucagcugugaacuauuggauuugagacaggaacagaacaaaucg
acgggccagaggagggguggagagagcacgagugguuuaaauagggggaggggagcaug
gcggugggggugggggaagaguuauuuacaagaaggcucaggggggccagaggcucaucuu
ggaauauuuuauaacaauauauauaagauucugguuugcuuuuccuuuucgucucguaaa
ggagagagaauugcauaguucgauucugccaagggggcagcugcauauggucggccggg
cgggucacuggucgu 111 AI851365  uuuuuuuuuuuuuuuaagugucaccacuugugacagucagcauguuacuaucagcucc
agccgcagcguuuuaaggcguuauagauuaggcaggcaauacaaggaacacgauuaaga
aacugacacguaccacacgagcaauuuccagaggcuccucuucugcggugcacacguaac
agugucuuuguugacauucagacaguuccuagggccacucuagagaggcgccuuccuguuc
ucaccugcaaggauauuguuugguuugguuugguuugguuugccuuacuauggcuuuuu
cuuucaacuacauuuugugucaugccuuguuagcuaaacuucaaauuuugccuuuguauauuu
acuacuguaaaauuagaauaauuucacuguucaucucauccucugucacugauggaaccua
gagacgccacaagagccacugccgugacauaccucacaagcuacauccccuguccucaaaau 112 AW047339  cggccgcggccaccggccugcgccaagcugcugcugcggcagccaguaccucggugaagc
ccauuucagucgcgaccugaacgaggcaagcggagggugcgcgagcucuaccgcgcuu
gguaucgggagcgugccgaacaccgugcacuuaaugcagcuggauaucacggugaaacaa
ggacgggauaaaguccgagaaaguuucaugaagaaugcccaugucacagaccccagagug
guugaucugcguacauuaagggaaagauggagcuccaggaaaccaucaaaguauggaag
cagcggacacacguuaugcgguuuuuccaugaaacagaaacaccaaggccaaaggauuuc
uuauccaaguucuauaugg 113 U06834  Sequence below.
gcaccugagcgcgggugccuggcgcgcccgauggauccguugagagggcccucgacggaaagucccaaacucggaucgcauuc
agccaaaguggacggcgcgcauggagcucgagcgcugcugugcugggcuucccucgccacugcuuuagaagagaccccugu
ugaacacaaaacuggaacggcggaucugaaaugggugacuuacccucaggcagagggcaguggaggggcuaagcggccu
ggaugaggaacagcacagcguccgcaccaugaggugugcgacaugaagcgucca
ggggccaggcucacuggcugcgcacuggcugggucccaaggcgaggugcuguccacguguaugccacgauacgcuucacca
ugauggaaugccugucccugccgagggccagucgcuccugcaaggagacauucacugucuucuauuacgagagcgaacguga TABLE 3-continued RNA transcripts up-regulated during HF stem cell activation.

SEQ
ID
No:Access. # Sequence uacggccacggcccauacgcccgccuggauggagaaccccuacaucaagguggacacaguggccgcagaacaucugacucgga
agcgccuggagcugaagccacagggaaaguuaauaucaagacgcugcgccug
gguccucucagcaaagcuggcuucuaccuggcuuuccaggaccaaggagccugcauggcucugcucucccugcaucucuuu
uacaagaagugcuccuggcugaucacgaacuugaccuacuucccgagacgugccucgggagcucguggugccgguggca
gguagcugcguggccaacgcgguccuaccgccaaccccagcccagccucuacugccgggaagauggucaaugggcugagc
agcaggucacgggcugcagcugcgcgccaggguacgaggcugcggaaagcaacaaa
guaugcagagccuguggccagggaaccuucaagccccaaauaggagacgagcugccugccugccgugcccagccaacagccacuc
gaauaacauugggucuccugucugccugugucgaauuggguauuaccgggcccgcucagaccccggaguucaccuugcac
uaccccaccucugcuccaagaagcgugguucaccauuugaaugguuccacccugcgccuggaguggaguguccccuugag
uccggaaggccgagagaccucacuuaugcuguucgcugccgagaugccguccuggggguuccugcuugcccuguggggc
gacaugaccuucgaccccgguccucgagaccugguugagcgcuggguggcaaccgagggcugcguccugaugucaccuau
accuuugagguugcugcuuugaauggugugucuaccuuagccacuggaccaccuccuuuugagccugucaaugucaccacu
gaccgugaggugccuccugcagugucugacauccgagugacucgucgucacccagcagcuugauccugucauggcuauc
cccagagcacccaguggggccgucggacuacgaggucaaguaucaugagaagggcgcagagggccccagcaguguucguu
uccugaagacaucagaaaaccgagcugagcuccggggcugaagcggggagccagucuaucugauccagguacgcgcagguc
cgaggcuggcuacggucccuucgccaggagcaucacagucagacucaacuggaugagagcgagagcuggcgggagcagcug
gcccugauugcaggcacugcgguugugggugugguccugguccugguggucgucaucauugcaguucucugccucaggaa
gcagagcaaugggagggaaguugaguacucggauaagcaugggcaguaucucaucgggcacgguaccaaggucuacauuga
uccuuuuacuuacgaagacccuaaaugaggcagugagggaauuugccaaagagaucgaugucuccuaugucaagauugaaga
gguaauuggugcaggugaguucggcgaggugugccggggucggcugaaggcaccagggaaaaaggagagcugugugggccau
caagacucugaaggguggcuacaccgagcgccagagggcugaguuccugagcgaggccuccaucaugggccaguucgagcau
cccaacaucauccgccucgagggcuggucaccaacagugugccgguuugauccucacggaauucauggagaacggagccc
uggacuccuuccugcggcugaacgacgggcaguucacagucauccagcuggugggcaugcugaggggcaucgccucggca
ugcgguaccuggcugaaaugagcuaugccaccgagaccuggcugcaccaguaacaguguaaccaggucugcaa
gguguccgacuuuggcucuccagauucuuggaggagaacuccucugaucccaccuacacaaguucccugggaggcaagauu
cccauccgauggaccgccccugaagccauugccuucaggaaguucaccucugccagugaugccuggcgcuaugggaucguca
ugugggaggucaugucuuuggggaacggccauacugggacaugagcaaccaggaugugaucaaugccauugaacaggacu
accggcugccuccuccuccagacugcccaccucccaugcugcaugcugugugguccgaaaggaccggaaugcccgg
ccccgcuuuccccagguggucagcgcucuggacaagaugauccggaaucccgcuagccucaaaaucuggccagggagaaug
gcggggccacauccacucuuggaccaacggcagccucacuacucugcuuucgguucuguggcgaguggcuucgagcca
ucaagaugggaagauacgaggaaaguuugcagcggcuggauucggcuccuuugagauggucagucagaucucugccgagg
accuucuccgaauuggagucacucuggccaggacaccagaagaaaaucuggcgacguggggcauaugaagugggagcaa
gccaggagcccuggugggacagggggaccagccagcaguucugaccuccaaggacucaccaccguggcagauucuucuuu
ccgggaggcagaguugguggggacucacaagaugagccccucccccugucacagccucccauuggauugcacuuugaac
agaggggucggagacacagauuuggggaaccugccauaugggaucauacaugugcccuccaggcgggaaccccaaacuc
agaugagugucuuuccuccaagacugggcaaagaaaacaucccaucgucucaaucuucccagaggcucuccccaa
gcgccuuccaccucaacgggcaugucccugcagaccaaagagaaagggugaccagccugccaacuuuggaguggaaaaugcc
gucccaggaggcaggaaggggcugucaggacccggugauguaaucauggguuuugaugccugacuugcugucaccacca
aaggcaaucauuuucccuuguaaaugccccuccccucaucugccuucauauugaagguucugaaguuuuacuguuuuua
uuuuguaauuuuuccuccuucccccuccccuccccuucuugccagauuuuguguguaaagggcaccugguuccacua
ucuccuguugggaacaaggacccaucgauauguucuagaacaguccuuggaaaugcca 114 AA980204    ggcagcgagacgagcucacggucgaggauacgggugaagcgggacaggagcaggagccgg
              agccgggccaaagcagaaggugcaggucggcgccggcgguugggcangagccagucaagc
              cggacagugaggagcggaugcagacggcacgaccauggccacgauggugcuuccucgaga
              ggagaagcugagucaggacgagauagugcugggcaccaaggcggugauccaggguuuaga
              gacccugaggggagcaucugucccugcuagcuccccuagcuucucaugaagcaggcga
              ggcugagcgggcucacaggagcgcugccuccuccugcgccgcucccuggaggccaucgag
              cuggggcuuggggaggcucaggugauccuggcauuaucaagccaucugggggcuguggag
              ucagagaagcagaagcugcgggcucaggugcggcccugguacaagagaacagugguugcg
              ugaggagcuggcagggacacagcagaagcucagcgcagugaacaggcgguggcucagcug
              gagaagagagcagcacaucu 115 AI843232    ggcagcgagacgagcucacggucgaggauacgggugaagcgggacaggagcaggagccgg
              agccgggccaaagcagaaggugcaggucggcgccggcgguugggcangacccagucaagc
              cggacagugaggagcggaugcagacggcacgaccauggccacgauggugcuuccucgaga
              ggagaagcugagucaggacgagauagugcugggcaccaaggcggugauccaggguuuaga
              gacccugaggggagcaucugucccugcuagcuccccuagcuucucaugaagcaggcga
              ggcugagcgggcucacaggagcgcugccuccuccugcgccgcucccuggaggccaucgag
              cuggggcuuggggaggcucaggugauccuggcauuaucaagccaucugggggcuguggag
              ucagagaagcagaagcugcgggcucaggugcggcccugguacaagagaacagugguugcg
              ugaggagcuggcaggggacacagcagaagcucagcgcagugaacaggcgguggcucagcug
              gagaagagagcagcacaucu 116 U59807     Sequence below.
augauguguggcgcgccaucugccacaaugccagccacggccgagacgcaggaggucgccgaccaggugaggcugggccag
gucaggccagucugagccaggccugcggagacccggcggccucagggaccggccugcccagacuggucagguccugcagcgg
guuccggggcggccacaagugugacugggagcuggggggcucuggaucugguugaagauucagggccgggaacuggggc
gagucuucugccgcuugcauacaagagggccacucacucuauuagggaacuagcccgggaacgguggagggacccgguggu
cccagaauucaggaaggcaguguuagaaccuagacgcaccuuuugacuuacacccaggccuaaacaagagaaagccaga
cugggcuacugugcuugucccucaaaagaaagagcuaggacuguuuagcucaguggcaggaauucaacugauaccaccacc
accaucaccaacaccgcccucagggaaaaaaaaaggaucaaaccagaaguuguagaacuugcuugugecuagucugaaac
gagggguggaccuugggccugggcugcccuuccuguacuguuagcagagcagagauucaguacaagguagggggagguu
caggguauuagcaagagaagaaaaguuaaacaaauccucucuucagcucuccugccacgccccaagcccaggacccuguccac

TABLE 3-continued

RNA transcripts up-regulated during HF stem cell activation.

| SEQ ID No: | Access. # | Sequence |
|---|---|---|
| | | uaagccuagcugaucuuggggaggguguuugcucugaacugaagguggccaagaaggaagugagucagcuccaugagacccuag aaaugaggaaauguuacagacacacuggccaggcaagggaaccuuggccacgugccacaucagcacucaggaggcagagacag gcgagucucucugaauuugaagccagcccaguuugcuuaguuccaugccagccauagcuacauagugugagacccuguccccc ccccccaaaaaaaaggagcuguguugunucuuuaucagugggggccaacaguunuaccaugucccccggaaugaggaguauuga aggcuggcaguguguguguggggggcaccugugcaugaaucuaaguccuuccuucucacccaccauccaggugaaguccc agcuugaaucgaaagaaaaucagaaguuugaugucuuuaaagccauauccuucaagagacagauaguggcuggcaccaaccu cuucaucaaggugggguacugauaguagcuugccaugaacugggacauagucacagguagagcagaguguccugcaacuu ccugcagagaaccccuuaaggggacauguacauguucugaggaugaauuuggguguuagggguucccggccuuaaagga ggagacaagggguuaucacuggcuaaguuauggcugguggccuguucuggcucaguuucaaggcugggunaagccugga acuggaaccuuaccuunucacucacaugucugucugucugucuuccuccaggnugauguugguggagauaaaugcgugcacu ugaggguguunucaaccccuccccccaugaaaacaagccuunugacccugucuuccuaucagaccaacaaagaaaggcacgaugag cucuccuacuucuga |
| 117 | AI152659 | gaaaauguuaagagccaucaaauuucuggauauuuugcuaggaaaaugaaauucuacacu uauuuuuuguagacuuuuuuuaaaugcuguuuacaugaauuguauuuuggaaaaaauauu auacgugcacccugugaugcaugaagugauuuaugauggcucugcuauguggggcagag gucaccuuauccuaugaucuggaaugunuacuuucuacaaaguaagcuuugnugggggau uuugcuuucauuucuuugnuagcugauguuauuuuaccaggugugcagcaggaauuacac cacuguguggaauuauaaaauacaucccaugugca |
| 118 | AI850090 | uuuuuuuuuuuuuuucucuggugaauauuunuauuagaggugacaguuucccaggugac aguuuunccccaaggaagcaaaucucugcgucuauaagggaagaccacagaaccuucacuu uguaaaunuaccugnuguaaunuauccaagaacacagcacagcaaunugcuuuaungngggacu cugaccuunaaguaacaaguunguunaacagaaaacacaucaaacaaaaggauaaunucucuaa uuaucaagucagccaucagcunuucuuaggagagagagagagagagugugugugnugugnug ugngugngugngngugucugucugucugucguugggnauccacuuagggccaugu gcanguuaggunaaaugcuccaccacugagcuguunucuunagccgcacununcucagaununuc agguugunugnuugnugnuugnunuuuaacuaggcaugaaaauaaacuucacuucaaau |
| 119 | AF064635 | See above sequence (AI850090). |
| 120 | AI843106 | uuuuuuuuuuuuuuugnuggaaauuacucuununaunugaaaaauaccaguaauacugacag acuucaaaucaaunuacgguuccagaauacaaaguacuuaauacaununuuuccaaacc uguuuguaucucaaaguuagcaunuuuuguaaaucaagnuacaaaugauaacuuncacua aaauaunuuccagcunuauucuunuaaggagcuguauaaccuucaaagucagggnucccgag gucagcagggcaugggcagaaugcaccuggcacucccugugcagcagacugcaaccaca uu |
| 121 | AF033186 | auggccagcuuuccccgagggunaacgagaaagagaucgugagaucacguacuauaggg gaacucuuggcuccagcagcuccuunugacaagaaaugugggngugagaacuggacgguu gcuunugcuccugauggunccuacunugcguggucacaaggauaucgcauagugaagcuu guccccguggncccagugccguaagaacuunucuunugcaungguunccaaaaaugnuaccaau ucaagcugucuaaaauuggcaagacaaaacaguaauggnugguucagaaaaacaagccuccu gagcacguuuauagacuguggagacauagucuggagucuugcuuuuugggucuucaguucca gaaaaacagagucgnugcguuaauauagaauggcaucgguuccgaunuggacaggaucag cuacuccuugccacaggauuaaacaauggucgcaucaaaaucggggaugauaunacagga aaacuccuccuuaaunuggungaccacaunugaaauggunuagagauunaacunuungcucca gauggagcuunacuccuunguaucagcuucaagagacaaaacucuaagaguguggggaccug aaagaugaugugaaacauggugaaaguauugcgggcacaucagaanuggguguacaguugu gcaunucucucccgacuguucuaugcuguguucaguuggcgccaguaaagcaguuunuccuu uggaauauggauaaauacaccaugauuaggaagcuggaaggucaucaccaugauguugua gcuuguagacuuucuccugauggagcaunugcuagcuacugcauccuaugacacucgugug uauguccugguauccacacaagggagaccuuuccugucgugggcaccuguunucccucg cccacuccaauaunuugcuggaggagcaaaugaccgaungugagagcugugucuunucagu cauguggacucgaungnugccagccunugcugaugauaaaaugunugaggnuucuggagaauc gaugaggauugnuccggnacaaguugcaccunungagcaaunggucuunugcugnugccuunucu acugaungcaguguunuagcugcugggacacaungaaggngnugauununugggcacu ccaaggcaagucccuagccuucaacauauaungncgcaugucaauccgaagaggaugugcc acccaagaaguccaaaaacugccugnuccuuccaaaauaunggcgunucucuccuaccgc gguuag |
| 122 | Z50159 | auggccagcuuuccccgagggunaacgagaaagagaucgugagaucacguacuauaggg gaacucuuggcuccagcagcuccuunugacaagaaaugugggngugagaacuggacgguu gcuunugcuccugauggunccuacunugcguggucacaaggauaucgcauagugaagcuu guccccguggncccagugccguaagaacuunucuunugcaungguunccaaaaaugnuaccaau ucaagcugucuaaaauuggcaagacaaaacaguaauggnugguucagaaaaacaagccuccu gagcacguuuauagacuguggagacauagucuggagucuugcuuuuugggucuucaguucca gaaaaacagagucgnugcguuaauauagaauggcaucgguuccgaunuggacaggaucag cuacuccuugccacaggauuaaacaauggucgcaucaaaaucggggaugauaunacagga aaacuccuccuuaaunuggungaccacaunugaaauggunuagagauunaacunuungcucca gauggagcuunacuccuunguaucagcuucaagagacaaaacucuaagaguguggggaccug aaagaugaugugaaacauggugaaaguauugcgggcacaucagaanuggguguacaguugu gcaunucucucccgacuguucuaugcuguguucaguuggcgccaguaaagcaguuunuccuu uggaauauggauaaauacaccaugauuaggaagcuggaaggucaucaccaugauguugua |

TABLE 3-continued

RNA transcripts up-regulated during HF stem cell activation.

SEQ
ID
No:Access. # Sequence gcuugugacuuuucuccugauggagcauugcuagcuacugcauccuaugacacucgugug
uaugucugggauccacacaauggagaccuucugauggaguuugggcaccuguucccucg
cccacuccaauauuugcuggaggagcaaaugaccgaugggugagagcugugucuuucagu
caugauggacugcauguugccagccuugcugaugauaaaauggugagguucuggagaauc
gaugaggauugucggguacaaguugcaccuuugagcaauggucuuugcugugccuuuucu
acugauggcaguguuuuagcugcugggacacaugauggaagugugauuuuuggggccacu
ccaaggcaaguccuagccuucaacauauaugucgcaugucaauccgaagagugaugucc
acccaagaaguccaaaaacugccuguuccuuccaaaauauuggcguuucucuccuaccgc
gguuag 123 X78683 Sequence below.
gaauuccgugugcaaggcgaggucuguaagcuggagcggggcagaggcuggcgggcaccccuuccugaccgcuggugccgc
cgccgccgccuucgggaggaucagacaugcccagaacuugaaggacuuagcuggacgccugcccgccgggccucggggcau
gggcacggcgcugaagcugcugcugggggccggggcgguggccuacggcguccgcgaauccguguucaccguggaaggcgg
ucauagagcgcaucuuuuuuaaucguauugguggcgcagcaggacacgaucuugucgcgaauuucacuucaggauccccug
guuccaguaccccaucaucuaugacauucgggccagaccucggaaaauccuccccccacaggcuccaaagaccugcagaugg
ugaacaucucccugcgugugcuguccccgacccaaugcccaggagcucccagcauguaccagcgucuagggcuggacuauga
ggagcgagucugccguccauuguuaaugaggugcucaagagugugguggccaaguucaaugccucgcagcugaucaccca
gcgggcucaggugucccuguugaucgaagaggcugacgagcgcgccaaggacuucagccucauccuggaugaugugagc
uaucacagagcugagcuucagccgagaguacacagcugcuguagagcgcaaggcaaguggcccagcaggaagcccagcuggccc
aguuuuggguggagaaagcgaagcaggaacagcgacagaagauugugcaggcugaggggaggcggaggcugccaagaugc
uuggagaagcacugagcaagaauccuggcuauaucaagcuccgaaagauccgggccgcccagaacaucucuaaaacgaucgcc
acaucacagaaccgaaucuaaucucacagcugacaaccuugugcugaaucuacaggaugaaaguuuacucgggauggugaca
gccucauuaagggguaagaaaugagugugggacaucaagaaccccaccaccagagaaguuggcacacuugccuggaaguuggagga
gccagcucggggucaagcacagccaccugcccaaggcaucaugugauggacuuuucuguaucugcccucuuggauuaagg
aagacugagaccagcccuuucagaggcuuccuccuuccuguguuggcugggaagcgggguggacaaugugauuucuccgu
gauuccuacagccuugagccucucccagagugggggagauaaccaccaugccaggaauuc 124 X68193   acccaccggcuuucggaccauggccaaccucgagcguaccuucauugccaucaagccaga
uggcgugcagcgcggccugguggcgagaucaucaaacgguucgagcagaaggggguuccg
ccuguggccaugaaguucuucgggccucugaagaacaccugaagcagcauuacaucga
ccugaaagaccgcccuuucuucccggggcugguggaaguacaagaacucgggccgugug
ggccauggucugggagggcucaauguggugaaaacgggccgagugaugcuggggggagac
caauccagcugauucaaaaccaggcaccauccgugggauuucugcauucaaguuggcag
gaacaucauucauggcagugauucagguggagagugcugagaaagagauccaucugugguu
uaagcccgaagaacugaucgacuacaaguccuugcccaugacuggguguacgaguagac
augaagaaaccagaauccuuuucagcacuacugauggguuucuggacagagcucuucauc
ccacugacaggauggaucaucuuuucuaaaacaauaaagacuuuggaacugaaaaaaaaa
aaaaaaaaaaa 125 AA062013  uuuugcuuucaacaugacagaugccgcuguguccuucgccaaggacuucuuggccggugg
aguggccgcagcaucuccaagacagcggucacaccaucgagagggucaagcugcugcugc
aggugcacaugccagcaagcaaaucacggcagauaagcaauacaaggggcaucauagacug
cguggauucguauccccaaggaacagggagagucucuggucccuuuggggcguggggaaccgguac
caaugucaucagauacuuccccaccaaggcucucaacuuggccuucaaaguuaauuccaa
gcagaucuuucuggguggugugaacaagaggacccaguucuggcgcuacuuuugcaggga
accuggcaucaggugguugccgcuggggcuacauccuuggcuuuguguacccucuugau
uuuugccgguaccgucuagcagcugauggggcaagcuggagcuaaagggaauucaaggg
ccuugggacugccugguaagcuucaaucugaugggauaagggcuguac 126 AI465965   auccgggaccccacggccccuuugcagcuugccacaagguucugagcccccuuggaauac
uuccgccaaugugugugauugacaugugugcccauaagggugacaaagccuaucucugccgu
agccuggcugcuuauacugcagcuguccagcagcagcuggggcagcagugaagcccuggagg
acagacagcgucugcccucuccagugccugcccacagccacuacuccaucugcaccccgc
uccugccagggcuuccugccugcucucucuggccucacuggcugcaccac 127 U50413 Sequence below.
ggcacgagccgaguuggaggaagcagcggcagcggcagcggcagcgguagcgguggaggacggcugugcagccaaggaaccgg
gacagcgaagcgacggcaggucgcagcuggaucgcaggagccuggagccugggagcuucagaggccgcugaagcccaggcug
ggcagaggaaggaagcgagccgacccggaggugaagcugagagugggagcguggcaguaaaaucagacgacagaugacagug
ugacaggaacgucagagagaggauugggccucgcugcgagagucaccuggaagguguggacaaguugcugagaaggac
acgugggaggacgguggcgcgcggagggagagcccugucuucagucaccccguugauggaggacaaugagcagcagccgg
acggccagucaccucucuuaaaccuuggauagugguccuuugucucugcuggacaccuguggggauuuuagcccauuc
ucugaacucacuuucucuuaaaacguaaacucggacggcagugugcgagccagcuccucuguggcagggcacuagagcugca
gacaugagugcagagggcuaccaguacagagcacuguacgacuacaaggaggcgagaggaacauugaccuacaccaccugg
gggacauacugacugugaauaaaggcuccuuaguggcacuuggauucaguaugcuggaagcccggccugaagauauug
gcugguuaaauggcuacaaugaaaccacugggggagagggggagacuuuccaggaacuuacguugaauacauuggaaggaaaag
aauuucaccccauacucccaagccucggcccccucgaccgcuuccuguugcuccgggucuucaaaaacugaagcugacacg
gaccgcaaggcguugcccccuucgagcuccuggcgagcaguccugaguggucaucugugccccgccucucccuuuauaaagcucc
uggaccauugaagaagaaagacuggaauguucacucuauacagaacacaaagucccgcaacccugcagaauuacgacag
cuucuugauguugaugccgcgucagugggacuggagaugaucgacguacacgucuuagcagaugcuuucaaacgcuaucuc
gccgacuuaccaaauccugucauuccuguagcuguuuacaaugaugaugucuuuagcccaagaacuacagagcccugaag
acugcauccagcuguugaagaagcucauuagauugccuaauauaccucaucaguguuggcuuacgcuucaguauuugcuca
agcauuuuuucaagcucucucaagccuccagcaaaaaccuuuugaaugcaagaguccucucugagauuuucagccccgugcu

TABLE 3-continued

RNA transcripts up-regulated during HF stem cell activation.

SEQ
ID
No:Access. # Sequence uuucagauuuccagccgccagcucugauaauacugaacaccucauaaaagcgauagagauuuuaaucucaacggaauggaau
gagagacagccagcaccagcacugcccccaaaccacccaagcccacuacuguagccaacaacagcaugaacaacaauaugcc
uugcaggaugcugaauggucuggggagacaucucaaggaagaagugaaugaaaaucccgagacacugcugauggagaccu
uuuugguacgagacgcaucuacuaaaaugcacggcgauuacacucuuacaccuaggaaaggaggaaauaacaaauuaaucaa
aaucuuucaccgugauggaaaauauggcuucucugauccauuaaccuucaacucuguggauugaguuaauaaaccacuaccgg
aaugagucuuuagcucaguacaaccccaagcuggaugugaaguugcucuacccagugacccaaauaccagcaggaucaaguug
ucaaagaagauaauauuugaagcuguagggaaaaaauuacaugaauauaauauacucaauucaagaaaaaagucgggaauauga
uagauuauaugaggaguacaccocguacuucccaggaaauccaaaugaaaagaacggcuaucgaagcauuuaaugaaaccauaa
aaauauuugaagaacaaugccaaacccaggagcgguacagcaaagaauacauagagaaguuuaaacgcgaaggcaacgagaaa
gaaauucaaaggauuaugcauaaccaugauaagcugaagucgcguaucagugagaucauugacaguagaggagguuggaa
gaagacuugaagaagcaggcagcugaguaccgagagaucgacaaacgcaugaacaguauuaagcoggaccucaucaguuga
gaaagacaagagaccaauacuugauguggcugacgcagaaaggugugcggcagaagaagcugaacgagaguncuggggaauga
aaauaccgaagaucaauacucoccuggguagaagaugaugaggauuugcccaccaugacgagaagacguggaaugucgggagc
agcaaccgaaacaaagcggagaaccuauugcgagggaagcgagacggcacuuuccuugccgggagagcaguaagcagggcu
gcuaugccugcucccguagugguagacggcggcagucaagcaugcgucauuaacaagacugccaccggcuauggcuuugccga
gcccuacaaccuguacagcucccugaaggagcugggucuacauuaucaacacacucccccgugcagcacaaugacuccccuca
augcacacuagcauacccaguauaugcacaacagaggcgaugaagcgcugcccucggauccaguuccucaccuucaagccac
ccaaggccucugagaagcaaagggcucucuccagcccgaccugugaacugagcugcagaaaugaagccggcugucugcaca
ugggacuagagcuuucuuggacaaaaagaagucgggaagacacgcagccucggacuguggaugaccagacguuucuaacc
uuauccucuuucuuucuuucuuucuuucuuucuuucuuucuuucuuucuuucuuucuuucuuucuaauuua
aagccacaacacacaaccaacacacagagagaaagaaaugcaaaaaucucuccgugcagggacaaagaggccuuuaaccauggu
gcuuguuaacgcuuucgaagcuuuaccagcuacaaguugggacuuuggagaccagaaggugacagggccgaagagccug
cgccuggggccgcuuggucagccuggugugagccuggugucgcuggugugugaacccagacacaucacacguggauu
auuuccuuuuuaaaagagcgaaugauaauguaucagagagccgcgucugcucacgcaggacacuuugagagaacauugaugca
gucguuccggaggaaaaaugaaacaccagaaaacguuuuuguuuaaacuuaucaagucagcaaccaacaacccaccaacagaa
aaaaaaaaaaaa 128 AW120502 uuuuuuuuuuugtuuuaauuuggcuccaaugaucgcauucucaaacuccuuugggaggg
cauuagaugacccaguauccgacgacuuagauucacacguguuuuucuccucugagcucu
uuucuccaggcucacngucuuuguuuuucaagcuuucuugggccuuugaacaauuucuu
ccuuugaagauucuccugg 129 X62940 Sequence below.
agccgaguaggaccgagcugcugcagacgcgccgggucacucgagccagcaccaccguucucacgcccugagcugcagacagc
uaggcgguuuuaucuaguuugaaccaggcugcuggagcuugucoccucccgoccucucuuuuuuuuuccacggggcuguu
uuuuuaauuuggcugcaauugcauugaaauaccaauggugagaccaggagaccagaguuuaccaucuagggagaguuug
uuuuuuccauuucuuucuugucgucuuugcugggaaccgaaaacgcuuccgugagacuugacaauagcucucuggugcaagugu
ggguagcuaucgacaacaaaauagagcaagcuauggaucuggugaaaagcauuugauguaugcggugaggaggaagugga
aguucugaaggagcagaucaaagaacuaauagagaaaaacucccagcuggagcaggagaacaacucugcugaagacgcuggcca
guccggagcagccugccgccaguuucagccccagcugcagacugggcucccccggccaccacgcagccgcacagggagaccacacag
cccccucgcacagccagcaucccaggggucucagggaucaaccgcauagccucuuaggccccaacagaacggcugcugcugcu
gucugaacugaacagaccgaagagaugugcuagagagaagccgccuccacaguccaccccauuucauuggcugucuacgaaagag
acgugagacucacacgcuguuucucgucucuucccccaguauuaagcacucauaagcuuuuggcuugaagaaaaugacuaguu
gagugaauuaaaggguuaaucagagaguggcagggauggcccugugcaacggugcagaugauguuuaauug
accccgaggagcucugugccuuuucaaccccucccagccgcccacccugcuucgagagcucgggcggcucgccuucgugg
gcucgccugcguggguucgaaaguggcucguccuuggauucugcgcucucuuucuccuucccuucaaagaacucggagagg
ccagaaacaagacucaaauggggggcgggggagggaugaugcaguccuuauacaaaaccgacaacugucaccaaaagcuuau
aaaacacgauaguacugcoccucuuuuucugaaccaucagaagacaacaguuaguagcacaacggugacagguagcugg
gaccuaggcuaucuuauuaugaagguuguuuugcuuguuguauauuuguguauggugaaacgaauuugaaccaucagag
gacucuccguaacuacuguuuagcuucuacacauugaaauugagauguuucauuggcugucugaaaaaggugugggcuugcc
uuccuagagagaucuacuuaaaaacugcuuuguggcaaaaaccacaccgaagaauuuuuaagaauuuggoccaguuaguca
cucugguguaaucccggaaucuagcugcugaagucuugcgaaguaaacuccocgugaccgaugucaguuaagcugggauac
cuggagaagugguucaguugcuaaggaaguggauucccaguaggggguuucugcaccucaccuguauagucguucugcgcau
guccccacacaguccccaccuguauuuaccuguucacuugucaccuuucauaaaagcauaucaaauguugau 130 U60020 Sequence below.
auggcugcgcacgucuggcuggcggccgcccugcucccuucuggugacuggcugcugcugcggcccaugcucccgggaauc
uucuccugsuuggsuucccgaggugccgcugucgggucgggsugguggggccsugagucgcugggccauccuaggacuagg
ggsuccgcggggsuccucggggucaccgcaggagcccauggcuggcuggcugcusuucagccgcugguggccgcacugaguuu
ggcccugccuggscusugccuuguuccgagagcuggccgccuggggaacacucgggagggugacagcgcuggauucugua
cuggaacagucsuccaguaussgucsusuccusussusuccssussssussussssussussssuuugggagsgcsucscsssuugsgggss
coccugsgscscccscscsggscsscssggsscsguggsagscsuggsuccsuscscsuggsuccssugsassgssgssgssgsscsg
ucucsuccugguussussuccuusgsusuccusugsgcsusgsggsssssusggccsscsucccuucsuccscgggsccscssuscscscsus
cuggsuscuusscsggsusssgsscsguuccuagsusucsscscgcsscsuugsgcucaugccauucscscsusgccagcacsgcg
cuggaguuugcaagugaugsaucascsscsuccsuggsgcsscsugscsugccsgsgsgsggsugsgsgscsscsgggggsccs
guccsuscgcsaggsgsacsgggguuuuccugaagsaccagcaggsuucsucaasucucgggugacugsggscscagcssaacg
ugucgaguccsuusgsugscacscsugssgccugcsugsgsuggusccsugssggcsgsgcccuguscscucsuggsugusscscsguuu
ugggggucaccgsasccsuscscscscscsgssgucacscscsccsgscscsausscscsuscsgcscsccscsuucsuucuuusgccusssgssagsgcsgggsssgsgsuss
caccagucacuggcsgsuagssusugsgggcscssgggscsscsccssgsgsggscscssucsgggcsccssuusscsgsgsgsusgssusgcsuss
ccgsucggagcuuusccaascgsgsaggguugsggcscsccagsgsgsgsucaggcagsaugggsusgsgssgsssascscsusssascsssagsss
ggsggccsuuggcsusacgucscusssagssugsccsssccsssgsggsgucsucgsssusgsscsusgsassgsguggsaasuscuguscssuuggg
cgggcagsusggsusacagsgsgscsusgsucssgssugccsssscssussugsccsussuscssgsssuuscsggscsuussuucsscscscgssgsusu
guucaggsusccugsuscuscscsucsuscscsccsuccscsusgscaggggsccsususgsgsggscscssuscasgsgsaaausssuuscsussusscsuusssgsssgsgsssusssscsgsscssussss
cuccuugcucuccacucsaguggcucguuggscsscsccucsaassussgsaasggccsusugusgsggsasgsuscssagsssusgscsuscsuuususgscsusus

TABLE 3-continued

RNA transcripts up-regulated during HF stem cell activation.

| SEQ ID No: | Access. # | Sequence |
|---|---|---|
| | | acccaaaccagcccaaagυccaggυgcυυcaggggcυgacgυυcacccυgcaυccυggaacggυgacagcgυυggυgggacc<br>caaυggaυcagggaagagcaccgυggcυgcccυgcυgcagaaccυgυaccagcccaccggggccagcυgcυgcυggaυggc<br>cagcgccυggυccagυaυgaυcaccaυυaccυgcacacυcaggυggccgcagυgggacaagagccgcυgcυaυυυggaagaa<br>gυυυυcgagaaaaυaυυgcgυaυggccυgaaccggacυccaaccaυggaggaaaυcacagcυgυggccgυggagυcυggag<br>cccacgaυυυcaυcυcυggguυcccυcagggcυaυgacacagaggυaggυgagacυgggaaccagcυgυcaggaggυcagc<br>gacaggcagυggccυυggcccgagccυυgaυccggaagccacυccυgcυυaυcυυggaυgaυgccaccagυgcccυggaυgc<br>υggcaaccagcυacgggυccagcggccυccυgυaυgagagccccaagcgggcυυcυcggacggυυcυυcυυaυcacccagcag<br>cυcagccυggcagagcaggccaccacaυccυcυυυcυcagagaaggcυcυgυcggcgagcagggcacccaccυgcagcυca<br>υgaagagaggagggυgcυaccgggcaυggυagaggcυcυυgcggcυccυgcagacυga |
| 131 | L32752 | gaaυυccggggccgcυcυcυccggcaggaυcgccgcgaυggccgcccagggagagccgca<br>ggυccagυυcaaggυcgυccυggυgggcgacggcggcaccggaaagacgacaυυcaυgaa<br>gcgccacυυgaccggagagυυυgagaaggagυaυgυagccaccςυgggcgυggaggυgca<br>cacaυυagυcυυccaυaccaacagaggaccυaυcaagυυcaaυgυgυgggacacagccgg<br>υcaggagaagυυcgggggcυgcgcgaυggccυaυιacaυccaagccςagυgυgccaυυaυ<br>aaυgυυυgacgυaacaυcaagagυυacυυacaagaaυgυgccυagcυggcaυaaagaυcυ<br>agυcgυgυgυgυaaaacaυccccaυυgυaυυgυgυggcaacaaagυggaυgυυaaaga<br>caυgaaagυgaaggcaaaaccυaυυcυcυυccaccgaaagaagaaυcυυcagυacυauga<br>caυυυcυgccagaagυaacυacaacυυυυgagaaagccυυυcυυcυggcυυgccagaaagcυ<br>caυυggagauccυaacυυggagυυcgυυgccaυgccυgcυcυυgcccaccυgaggυagυ<br>caυggacccagcυυυggcagcacagυacgagcaυgaυυυagaggυυgcυcagacgacυgc<br>υcυcccagaυgaggaagaυgaccυgagaaagυgaagcυggagcccυgcgυcagaagυc<br>υaυυυυaggcaacυgυcυgυgaυgccagccagcggυgcagυgυgυgυgccaccυuaυυυ<br>agcυaaaggagaυcgυgcaauυcaυυggaυgcυgaaggagaυgaaυgggcυυccυggagυg<br>aauguggcagυυaaaaυacaccυυcaυυυυυυggacυυgcgυaυυυagccccccυggaac<br>agaguυgυυcυggauυυcaaagauaagacυgcυaccgυagcaυcacaauagυcagυggυg<br>accggaaυυc |
| 132 | AI840013 | uuuuuuuuuuuuuuuuugauuuaugaaaaguuuuauuuaucagυacυgυgaagaauυcυc<br>aυcaυaauυgcυacgυυaaυcaaggaaaaggcacagagaagcaυgυgυcgυuυgagυccυ<br>cgauacυggacccuccagcccaυgcυcccuaυgaggagυcυagcυgcυgυggυggυcυυc<br>acagcυυυggυuυcυggagacgaagcυcaυgaυυgcgυυcaυgcacυccυcυgacagcc<br>accυυgcυυgcagagυagυgcacυcuυcagcgυυgacυgcgυagagcυuuυcυuυcucaυ<br>uuuuucυgaυυaacυcυuυggaaauυucaυuggguuuggcgggagcυυcgcauau |
| 133 | AB020424 | υcgggaaυcgaυυgagagaccgcgaaccυgυaaacggaυgaυaccgagυcgggcaggcgυ<br>υaυgccagcccaacυccggaccυcgcaυcaυgυccgcggcυaccυυagagυgυυυcggga<br>aυgaυυυgcggυgaυgaacgaaaccccggυacgυccυgυgccaaggagcaυaυgυcagg<br>acggacgcυcgυυaaυgccυcagυgguυgggcaacguυcgcυcucυaυcυaυacgacυcυ<br>cgacaaυggaυaaυcυcggcυcυcgcaυcaauυgaagaacgυagcgaaaυgcgaυacυuggu<br>gυgaauυgcagaaυccυgυgaaccaucgagυcυuυgaacgcaagυυgcgcccgaggccuu<br>υcgguυgagggcacgccυgccυgggcgυcacgccυυguυuυgcυcυgυgcccgυgcυcυu<br>ucggggυgcggυcauggaυgcggagauυggcccuccgυgccυcgυgυgcggcgggcυυaag<br>cgcggggυgυcggcυcgggaaggggcacgacgagυggυggacggagcaccagcaggaυgu<br>υguggυccccεgυcaccυυaagggggcυcaagagaccςggacuaggcgagccgcgcυυcgυ<br>aagaggagggcgagcυgυcυcgcaau |
| 134 | AI848453 | uuuuuuuuuuuuuuuuuugaagυυgcυgccccuuuaυυggυgacccgggcaaguuuaagga<br>gaacaacauuaaagcacacaaagυgυaυccauguscaccagcυcaaccaggaggagυgagg<br>gucacggcaggguυcυcccaυgguguaagaaaυcaacgcaauuυcauccauacaccccguυac<br>uuuccaaguυaacgaaccgaυaagaaaagauuccccuuaaacυgacaaguacaauguac<br>auguacauagaυυυuggaauaauυuaauacυυυυaaccυcaagauacaacυauaυυcυaaga<br>ccauυauυυaaaggaacggauccuuacaaaaccaaaauaaccauauagcacgaggυυg<br>guυυagccυυυcuυcuυcuυυcaacaaacgυgcaccacauguυυcagυagcaaggccgaυ<br>gccauggauaυagagcυgυgaυυυgcagggaccaaccacaυcυagaaccggggaggcca<br>aυcanacgguggguυ |
| 135 | AU040563 | cccυυggaggaυaguuυυauυgacaagυcgagυυaggυυυuagagυaaacuuuuaucacc<br>ccagυcaggccccυυcccaggggaggcυccυcggυagcυcagauggccυuggυgugυgggc<br>agauugυυguaguυgcυυccυggcccυccagcaggcυυcgggaggυggcυaυcυccυgc<br>uccagcuggacuυgauguccaguagcυgcuυauacuccgggguυcυggcgcυcυauguugc<br>ggcacgcaggυgcngcg |
| 136 | X89749 | Sequence below. | ggacυgacυccυugggcagauυgccυcυccuυcυcaugccagaggcυgcυgaυgaggaaaggυccaggggacugυcca
ugcυgυcυυcauccυcagaguscacυgccugaυgcυgcaacaagaccυυcυυgυuυagcaauagυgguuggaacacucυcυ
ugυaaguυaccggagcacυagυaυaggaggaggaυcaυcgacυacccucccgccacυccacggcυgcυggcυccυagaaacc
ccagcuυcaccυcυcacυgggacυcgaguccagaaυgaaaagcaagaagggυcuυguυgcagcaυcaggcagυgacυcυga
uguuυguυaccgагcguагυаcaacυgauυсаасgcccgccgcagggacυgυссgagacauagacaυagacaυаgасаυаgac
aaggagυcagυcagaυυcgcgagacυggcυguaυgaacacagaυacaacgccυauccccυcagagcaagaggaaagcacυgc
ugυcccagcagacacaccυgυccacacυacaggυcυgυaacυgguucaυcaacgcccgccgcaggυcccuυccυgacaugcu
gagaaaggaυggcaaagaυccaaauscagυυcacgaυυccsgccgυggggccaagauυυcagaagcυagcυcυauυgaagcυ
gcaauggguaυcaaaaacυυcauqccaacυcuagaagagagcccauυucauccυgcυaguuggacccaaccaacccuag
ggagaccaguςucuccaaaccυccccυccccaggaυccauυuuggcυcgcccgυcagυgaυcυgccaυaccacugυgacυgc

TABLE 3-continued

RNA transcripts up-regulated during HF stem cell activation.

| SEQ ID No: | Access. # | Sequence |
|---|---|---| auugaaggaugggccuuucucucucugucagccgauuggugugggacagaguacagauguaccgcaaauagcacccagcaac
uuuacagacaccucucucguguacccagaggacacuugcaaaucuggacccaguccaaaccucagaguggucuuuucaaca
cuccuccccuacuccaccagaccuccaaccaggauuuuaguggauuccagcuucuagugggauguugcacucaaacgagcggc
agagauggagcuucaggccaaaucucacagcuuaaccguuuuuucaaacaaaacaguucuccaaaauacgguccugauugccg
ggggugauggcaagagaugcauuauuuuauauauuuuuuc 137 AW125390  uuuuuuuuuuuuuuuuggugguuaucaagugcacuuuauugaauccacuguggauagau
aaaugaguguuacaccugcguguagggaggggcaaggagggacgcagcugcggagggguga
agcacuucaggaccggaagucggaauccucuauuaagugugaagguuuugagcguuaaga
acaaugaugaugacacuaacaaugugauaacaaccaucaggaugcugaggaccaaggug
cugauguucaggcacuuagcagugggaggcguaggccuggggcuccagucacaucaccacc
aucuuccgaucccuagacuucacggaguaggcauaggcuaugaagcccaggcagcagaag
uucaugaagagauguauugaacaggaccagaccacaugucaggcaccgacaccucucug
ggcauguugaucacaguaguucugacagaagccga 138 X05862   Sequence below.
aagcuucaggauacagugcacacucguaauaaaaacuacaggcugcugcgaauuauauuucaacugaccggagaggcaaag
ccugacuguccauuaacccuuaacuuccaaacgcaaacugcuuacugcaucuuuuggcauuuuaccuuaugccuuguuagg
uccaaggcaagagaagcgucaucaauaaccacgcauggcaacagcuuuuccagaggaagggugugggguggcuuuaaaaga
gccuuugaguuaggagugugagauuaaacgagcucauuggagcugguguacuuggugacugccuuuggugcccuuccgacacc
gcgugcuuggccagcucccccgggcagcagcaggcgcacggccgucuggaucucccgggacgugauggucgagcgcuuguug
uaaugcgccaggcgggaagccucgcucgcgaugcgcucgaagaugucguucacgaacgaguucaugaugcccauggccuug
gaggagaugccgugucgggugcacuugcuucagcaccuuguacacguacaccgaguagcucucccuugcgggcugcgcuug
cgcuucuugccguccuucuucugggcugacggccuucuuggagcccuucggggcgggagcggacuuggcggg
cucaggcauacugagaggaugaagugaacuaaguugaaaaaggauaacuaaaaguuaaugacuguucuggcugcaauuuuaa
acaaacuuacggcuauggcaaccugaaucaccauacgucaugugacuaacaguccaaucaaaacaagggauuuucaaaccaggg
cgccauuggauaaccaaugguaaccaaugaaaucucuccguuuucgcguccagccuugacuauauauauacuaugcguauacgu
uuuugccuucuuacugccuguggguuuaucuacagcugaaugucuggacguggcaagcaagauccaagcugguggcaagcaaggaggca
aggcccgcgccaaggccaagacgcgcucccucccgggccggccugcaguuccccguggggccgcgugcaccggcugcuccgcaa
gggcaacuacucgagcgcgugggcgccggcgccccgguguaccuggcggccgugcuggaguaccugacggccgagauccu
ggagcuggcgggcaacgcggcccgcgcaacaagaagacgcgcaucauccccgcgccaccgcagcuggccauccgcaacgacg
aggagcucaacaagcugcugggcgcugaccaucgcgcaggcggcguccaacauccaggccggcugcgucugcccaa
gaagaccgagagccaccacaaggccaaggggaagugaaaccaaacauuacgaaucaccaaggcucuuuucagagccacucacu
uucucaaagagaccuaacacuacugggauaguagcauugugggaaauacgguguauaaccuuccuccuauuuucccugcuug
ugguuaguucaaccccuaagccuuaggcuaagaguauuauggguuuuuggaaggcaggcacccaaccucgaccuaguacaua
aaacagacacauccuugaacuccaggccagccuacucgcaggauccaggacgacugcacaaagaaauugucuu
gaaauguuccuuuaucagcacauaugcugauaaaacaacuaaucacguaacaaucaauccucacuugaauccuguuuaugug
caugauugacaaguccugccauuuggcaaagucaaaaucagcaaaggaugjuuaaagcauuugguggjuacacagcuaaaac 139 AW046181  uuuuuuuuuuuuuuaugcaaauaguuuucaagauuuuauugcaaaccaaaauugguuua
ucgcacacaaaaaaguugugugguaaggaggaggaauuguacaggauuauaaccccaugu
uaauuacaguacauuaaaaugauggguuuuacaaauaagccuguaaguuuaaauaucuagug
uuauaaccccaaaugguacagacuuccuuuacacgauacauacaauaaucaggaaugcaaaag
aauaugaacaaagggaaaaaaaaacauaaaauaugcccguuuuauaggugacauuuuaaac
aauugaaaacaccaaccggcuuugacugacaacugggggcauuggccauaaaaaccccuuuu
cuaaaaauagaaauau 140 U10118    Sequence below.
gaggcugcucaagagcugcgguuggucaccgcuucauguuucucugccgauucuggggaaagaugcaacgaaugaugcu
guucugaagaggcuggagcagaagggugcagaggcggaucagaucaucgaauaucucaagcagcagguugcucuucuuaag
gagaaagcaauuuugcaggcaacaaugagagaagaaaagaaacuucgaguugaaaaugcaaacugaaaaagaaauagaaga
gcuaaagcaagagcugauucuggcagaaauucauaacggagggagcaagugcguguucgauugaguacuccacugcagacg
aacugauacugcuucugaaagugugugcagucucuccaucaguagcaaccaccgccuucuccugcuacaaaagagcagaucaaag
cgggagaagaaaagaaggugaaagaagacugaaaagaaaggagagaaaaaggagaagcagcagucgcagcagcaaguacu
gacuccaagccuaucgacgcaucgcgucuggaucuucgaauugguuguauuguuacugcaagaagcacccugaugcagau
ucacuguauguggaggauagaugugggagaagcagccccgcgcacggucgucagcgggcuggugaaucaugauccucua
gaacagaugcaaaaucguauggugguuuuuacucuguaaucuguaaagccugcaaagacugucugucaagcaug
gugauguogccaguucaccagagaaagugagauucuggcccuccccaacgggguccguuccugggacgaauuacuuuu
gaugcuuuucuggagagccugacaaggagcuaaacccuaagaagaagaucugggagcagauccagccugaccugcacacca
auagcugaguguggccacauacaaggagcucccuuugaggugaagggaagggaguuugcagagcccaaaccauggccaa
uaguggaauuaaauaagugcucuguaacugaaagacauuggcgaaaacuuaauaacaauaaagagaagugguuuuaucacuu
acauau 141 AW212775  ggccuuguuuuugguuugcaauaaagaguauuucuuuaaaaggcacauuuuguuaaauag
gcaguuccccuccugcucuuccuuuguagcaguguacugcauccuagaaacauuuagca
aagcagcccuuagccuccccgaccccuuucccucccucccagca 142 AI846302  uuuuuuuuuuuuuuaaacaaugacgccguuuauuuaaaauguuuacucccagaaaua
uagauauaaaaaaaaauaagacaauuaacagcacuaaaccaggcaccuucaaccgaau
cccaccauccucguuaacucccuuccuguuaccuuuguagaugaccagaagauuucagg
agcccugaacagccagaguggguuccugcccagggcuucccgccuuccuccuguccuaga
gcuucccgugggaaagcuggguggagaauuuagccuaaagggaggggggcugugccggg
cacuuugcgcucauccacugcagg

TABLE 3-continued

RNA transcripts up-regulated during HF stem cell activation.

SEQ
ID
No:Access. # Sequence

143 M22998 Sequence below.
acaggguacaguugugcgucagggcguggaggucuggcgggagacgcauaguuacagcgcguccguucccgucucgcagc
cggcacagcuagagcuucgagcgcagcgcggccauggauccagcagcaagaaggugacgggccgccucaugugugcugug
gaggagcagugcucggaucacugcaguucggcuauaacacuggugucaucaacgccccccagaagguuauugaggaguuca
caaucaaacauggaaccaccgcuacggagagcccaucccauccaccacacucaccacgcuuuggucucucuccguggccaucu
ucucugucggggcaugauugguuccuucucugucggccucuuuguuaaucgcuuuggcaggcggaacuccaugcugaug
augaaccuguuggccuuugugcgcugcuguguguuauggcuuccaaacuggcaaguccuuugagaugcugauccuggg
ccgcuucaucaucgguguguacugcggccugacuacuggcuuugugcccauguaugugggagaggugucaccuacagcucu
acguggagcccuaggcacacugcaccagcugggaaucgucguuggcauccuuauugcccaggguguuggcuuagacuccau
caugggcaaugcagacuuguggccucugcugucagugucaucuucaucccagcccugcuacagguguauccuguugcccuu
cugccccgagagccccccgcuuccugcucaucaaucguaacgaggagaaccgggccaagaguguggcugaagaagcuucgaggg
acagccgaugugacccgagaccugcaggagaugaaagaagagggucgcagaugaugcgggagaagaaggucaccaucuugg
agcuguccgcucaccggccuaccgccagcccauccucaucgcguguggcugcagcugucccagcagcugucggguaucaa
ugcuguguucuacuacucaacgagcaucuucgagaaggcaggugugcagcagccuguguacgccaccaucggcuccgguauc
gucaacacggccuucacgugugugucgcuguuuguugaagcgagcuggacgacggaccugccugccaccucauuggccuggcu
ggcauggcaggcugugcugugcucaugaccaucgcccuggccuugcuggaacggcugccuuggaugccuaucugagcauc
guggccaucuuuggcuuuguggccuucuuugaaguaggcccuggguccuauuccauggguucauguggccgagcuguucag
ccaggggccccguccugcugcuauugcugugggcuggcuucuccaacuggaccucaaacuucauugugggcaugugcuucca
guaugugaggcaacugugcggccccuacgucuucaucaucuucacguggcuccucgugcucuucuccaucuucaccuacuu
caaaguccugagaccaaaggccgaaccuucgaugagaucgcuuccggcuuccggcaggggggugcagccaaagugacaag
acacccgaggagcucuuccacccucuggggcggacucccaagugugaggagccccacacccagcccggccugcucccugcag
cccaaggaucucucuggagcacaggcagcuagaugagaccucuuccgaaccgacagaucucgggcaagccgggccugggcgc
cuuuccucagccagcagugaagucc.aggaggauauucaggacuuugauggccuccagaauuuuaaugaaagcaagacugcu
gcucagaucuauucagauaagcagcagguuuuauaauuuuuuauuacugauuuugguauuuuuuuuuuuucaucagccac
ucuccuaucuccacacugUagucuucaccuugauugggcccagugccugaggguggggaccacgcccugUccagacacuugcc
uucuuugccaagcuaaucuguagggcuggaccuauggccaaggacacacuaaauaccgaacucugagcuaggaggcuuuacgc
uggaggcgguagcugccacccacuuccgcaggccuggaccucggcaccauaggggUccggacuccauuuuaggauucgccca
uuccuguCucuuccuacccaaccacucaauuaaucuuuccuugccugagaccagUuggaagcacuggagugcaggga99aga
gggaagggccaggcugggcugccagguucuagucuccugugcacugagggcacacaaaccaugagaaggaccucggagg
cugagaacuuaacugcugaagacacggacacuccugcccugcuguguauagauggaagauauuuauauauuuuugguugu
caauauuaaauacagacacuaaguuauaguauaucuggacaaacccacuuguaaaucaccaacaaacuccuguaacuuucacc
uaagcagauauaaau
ggcugguuuuuag 144 X64837 Sequence below.
gcuuucuaaacuagcaagcaucguguggguccuucaggagugggagugcagacagaccugacagcguccgcuaagcgacacu
gacuguacuuccacuccugaaggacccacacgaugcuuucuaaacuagcaagucugcagaccauugcugcucugcgccgagg
aguccacaccucagucgccucugccacgucguugccacaaagaagacagagcaaggccaccauccuccgaguacauuuug
aacgggaaucuaaauaugguugcacacaauuaccauccuuugccuguagcccuggagagaggaaaaggcauuuauaugugga
uguggaaggcaggcaguacuucgauuuccugagcugcuaugggucugucagccaaggcugcaccaagaucaagau
gccaugaagagucaggUggacaagcugacauuaacaucucgggcuuucuauaacaaugccuuggugaauacgaggaguaca
ucaccaagcuuucaacuacaacaaaguucucccuaugaauacaggaguggaggcuggagagacucauguaagcucgcucg
ucguuggggcuacaccgugaaaggcauccagaaauacaaagcaaagauuguuuuugcugaugggaacuuuuggggucgaac
acuaucugcaauccuagUuccacagauccgaccaguuagaugcuuuggaccccuucaugccaggcuuugaaaccauccca
uauaacgaucugcccgcacuggagcgugcucuucaggauccaaauguugcugccuucauggUggagcccaucaggguga
gcaggcguuaucguuccggauccaggauaccugacaggaguucgggaacucugcaccaggcaccaggUccuguuuauUgcu
gaugaaauacagacaggauuggccagaacugguagauggcuggcugUggaucaUgagaaaugucagaccugauauggucuu
cuugggaaggcccUuucuggcgguuuauacccugUgucugcagugcuggugUgaugagaaaUgcugaccauuaaacca
ggcgagcacggccUccacauacggcggaaacccacuagggcugccgaauUgccauugcggcucuugagguUuuagaagaggaga
aucuugcUgagaauggcagacaagaugggcgcuauccugaggaaggagcucaUgaagcugcccucugacguUugugaccucag
ugagagggaaagggugcuaaaugccauUgucaucagagaaaccaaagacuguGaugcuggaaggugugccugcgacuuc
gagauaacgggcuucuggccaagccaacccacgguguauaucaucaggcuugcccucccccuugugaucaaggaggaugagau
ccgggagUccgUggagaUcaacaagacUaUcUuGccUucgagagaggUaacUcUgggagccaUcUcagacaGGGc
ucuugUgaaacUcUgcUugcagUggccagagccugucuccugaaaggcauauauuucaguUgaugcauaauagagUgacac
cuaggaaccUgcaggUggcUgcgUgacagaaaagUgagagcgagaggcgaggcgucUcuuUgUugagGuuugacUGUGUGg
gaacuuucuaaggagaaacggaccCaucugcguacagCCugCagauggaggccugcagUcauUuacgugCgucuUuUacaguu
uccUuGCuGaugUgaauggUUUugUauuuagaagaaucUgaGaauaacagaacaaguaaaaucauuauaaUcaaugaau
guUaaguugaagguUaagcaUaUguaaaauacuaguuuaaaguaaacuuuUcauUggccaacaccagaaugUauUau
auagauucUgagaauucauuacuaaauuacacuUugcuuugauUgcaauUugUaaaacauUuaUUUucaguauUucuUUgaa
uaaagcuuaauguuucuuuuuacgccaacagaguauuuugUauuccauuuggUaauaaucaguguauuaauucaUccu
gaugacuggcauucaucaccauugaGaucacggguguguuucaggccuUUauucuaaauaaagcuaugaccaguUuc
ugucugu 145 AI843119 uuuuuuuuuuucuuuuccgacgcccacaagaggaauaagagauuuaaugauggaaagua
uggggaaaucacaguuuucagacaugaguaaucaaaaacuugacauuuucuugauaucc
aaaucuagaugucuguaucaaccagagguGauggccuuggggauggcagugaagacugu
uaggaccauuagaucagau 146 AI837786 uuuuuuuuuuuuuuuacaguuuuaaaacaauacacagcuuucucgggcugaagcaauu
gcaagaacguauugguauggUauauuacagcuacauacaagguuuaugaauagcaaugg
agaaaaauaaguuauuuaaauauugacuucauaaagagaaagugcaauguuguuagUugU
cauaucacuugcuugacagUuugUgggguuucUuccuaucaauUuuaacaaucaagaua
acaUggacucaagacagaauUuuucgggaaccUcacucaguccucacacagcagugacuu TABLE 3-continued RNA transcripts up-regulated during HF stem cell activation.

SEQ
ID
No:Access. # Sequence

```
              gggaaucuacguguguuccaccgcaguugugaaacacacuacuccgguccaggacucau
              uucucagagaagaaucaauucgaguuccauccacaccugggucgggacaca
```

147 U41465    Sequence below.
```
ccgggcucgaauucucuagacucgaguuuagagaauucgagcucucccaguuuuaaagcaaaauuuuggacugugaagcaa
ggcacugggcaaacacaacauggccucccggcugacagcuguauccaguuuacccggcacgcuagugauguucuucuaac
cuuaaucgccuccggagucgggacaucuugacggacguugucaucguggugagccgugagcaguuuagagcccauaagaca
gugcucauggccugcagcggccuguucuacaguauccuucacugaccaguugaaaugcaaccuuagugaaucaaucuagauc
cugaaaucagcccugaggguuugcauccuccuggacuucauguacacaucuaggcucaaccugagggaaggcaauaucau
ggcggugaugaccacagccauguaccugcagauggagcauguugucgacacaugcaggaaguucaucaaggccagugaagca
gaaauggcccugcacuuaaaccucccgugaagaguucugaacagccggaugcugaagccccaugacaucauggccuacc
gaggucgugaggucguggagaacaauaugccacugaaaauaccucccgggugugagagcagagcuuuugcuccuccucugu
acagugggccugucaacaccaccagccucuuauccccauguacagccaucccgcucagcaccuuccucuucucugaugagga
gcuccgagaugccccccgaaugccugggccaaccccuuucccaaggagcgugcccucccccgcgacagugccaggcaaguc
ccuaaugaguauagcaggccagccauggaggugucccccaguuuuggucacagcaacaucuacucgcccaaggaggcaguuc
cagaggaggcucggagugacauacacuacaguugugccugagggccccaagccugcuguccuucugcucgggaaugcuccaua
cuucccccugugacaaagccagcaaagaagaagagagaccuucuucggaggaugagauugccugcauuucgagcccccaau
gcacccuugaaccgaagggucugguuagucccccagagucccccagaaauccgacugccagcccaacucaccccacagaguccug
cagcagcaagaaggccugcauccuucaggccucuggcucucgccagccaagagccccacugaccccgaaagccugcaacugga
agaagauaaguucaucguucucaacagccucaaucagaaugccaaaccccgagggcucugagcaggcagagcugggucgccu
cuccccucgagccuacccugcaccgcccgcuugcagccgccucuauggagcccgcgaaccuugaucuccaguccccgaccaagc
ucagugccaguggggaggacucuaccauccccaagccagccggcucaauaaucucgugaacaggucccggggaggcucccc
ccgaagcagcagugagagucacucaccacucuaccaugcacccccccaaagugcaacucgcggcucugucccccacagcaua
cagagaugugccuccauacugcugggcccacguuccggaggaugggggaaaccagucagaguauucggauucuagcu
gugagaauggaccuucuucgcaacgaaugugacugccguuucucugaggaggccucgcucaagaggcacacgcugcagac
gcacagugacaaaccauacaaaugugaucgcugccaggccuccuucccgcuacaagggcaaccucgccagccacaagacugcc
acacgggugagaaacccuaucgcuguaacauuuguggagcgcaguucaaucggccagccaaccugaagacccacacucgaau
ucacucuggagaaagcccuacaaaaugugaaaccugugggggccaggguuguucaggugccccaccuccgugcccacgugcuc
auccacacuggagagaagccguacccucugugaaaucuguggcacucgcuuccggcaccuucagacucugaagagccaucugc
gcauccacacaggagagaaaccuuaccauugugagaaguguaaccugcacuuucgucacaaaagccaacugcgacuucauuu
gcgccagaagcacggcgccaucaccaacaccaaggugcaauaccgcgugucggccgcugaccugccuccggagcuccccaaag
ccugcugaaugaagcauggagugauccucgcccuuuccucuccagcccccuucucagaaucuacccaaaggaugcuguaacac
uuuauacaaaggucaucccaugauguagugccucucucauccacuagugcaaucauaguuggggugggggugg
```

148 U70494
```
ucgcggguccgacggaggagugggcgcuggaucucgcugagcguccgccuggccucgucu
cuuccucgcucgucggagcuucagcacggccgagauggcggcgguaaggcuggaaagg
acuccggaaaggccaagacaaaggcgguuucccgcucgcagcgagccggcuugcaguucc
cugugggccguauucaucgacaccugaaaucuaggacaacagccacggacgugugggcg
cgaccgccgcugugucagcgcagccauccuggaguaccucaccgcagaggacuugagu
uggcaggaaaugcgucaaaagacuuaaaggugaaagcguaucaccccucgucacuugcagc
uugcuauacguggagaugaagaauuggauucucugaucaaagcuaccauugcuggguggug
gugucaucccacacaucacaaaucgcugaucgggaagaaaggacaacagaagacuguuu
aaggaugccuggauuccuuauuaucucaggacucuaaauauuccuaacagcuguccagug
uugggauuccagugggacuguaucucugugaaaaacacaauuuugcuuuuuuguaauucu
auuugagcaaguuggaggcuuaauuagccuuccaaccaaccaaauuucugcauucgaguc
uuaaccauauuuaaguguuacugugggcuucaaagaagcuauugauucugaaguagugggu
uuugauugaguugacuguuuuaaaaaacuguuuggauuuuaauugugaugcagaaguua
uaguaacaagcauuugguuuugacagacauugucccacucggguggauaagcucaaua
aaggucauaucccaaacuagcuuuaaacugcuuaauaaucgggucuuaccuuagaucuc
acucagcaacaaguacauucucugcuuacuaauuaaacagugcaucuguagucauaaaaa
aaaaaaaaaaaaaaaaaaaaaaaaaa
```

149 D17666    Sequence below.
```
caccaccgugcacgcagcuccgggcccgggggguguuggcuucugccccucguaaccccucugaccagccaccaugauaagc
gccagcagagccgcggccgcgcgucucgugggcaccgcugcgucccggagccccgcagccgcccguccccaggugagaagcu
gccaugccuuccgguggggcuccaggcccggacucgagugaggcaggccuugccuucgggucagacucuaggaaaaauccg
gagcgaagggaugugaacggaccuucgugggcauuguugccuucugugagcguuuagcucaguggcugagucaca
auccuuggcguuccuaagucuuuacccccgcuaauugagacgucucuccccucuaaccugugcgcuuugaaugugccugg
acuuaggcaguggacguaguuuacuggaaannnnnnnnnnnnnnnnnnnnnnnnnnnnnnnnnnnnnnnnnnnnn
nnnnnnnnnnnnnnnnnnnnnnnnnnnnnnnnnnnnnnnnnnnnnnnnnnnnnnnuuuuacauacuaaggacuaaagcuug
caugugguccucagaauaugaaaagcccuagcuuguguguaugguggauggcuggaugcacuuuuuucccccagguggcug
gaauggccuuagccaugaggcuuuuagauuuguuucaagaagagauuaugcguaaguacaaccucaguuucucugagaaaa
aaaaaaaacacuuauuugaaccucaaagcuggaugggguugggugcguuauacauuuguacuguaguuuauucaauaugcc
acugguaacaccaacauaaaacacaguucuucguauuggagaccacuguucagaugaccauggaauuucauucuuacagau
cagaagcaaucaaggugcagugguuggaauaggcagucaacuccuguugcuguuuauggagggcaaacaag
caaaggugagcaugauuggaaaccugaggucacuuagauacccagucuggcauuaaguacauaggaaugcugagucggagcc
cagguuagugguggcacuuuaaaccuaguaaaggcagagggaucucugaguucaggaccagccuagaguacaaagugagn
nnnnnnnnnnnnnnnnnnnnnnnnnnnnnnnnnnnnnnnnnnnnnnnnnnnnnnnnnnnnnnnnnnnnnnnnnnnnn
nnnnnnnnnnnnnnnnnnnnnnacuuuaaacaguguuugggaauuuuaggccuggaguagucggaaggugccaga
acuaccccuucugugguugccuuuacagcagauggagaacgacuuguugaugcaaaacggcaagcugucaccaauc
caaacaauaccuucuaugcuacuaagcgucuauuggacgacgauaugaugacccugaagucagaaagacacgugaguaau
aggaaaaucaguccagaagacugguguuugaucaaaguucuguggauaccugaguucuguggaucaccuuggaucacuu
uuucauuauuucugcuugggaagaaaucacaccaccaucagaggcauauagguuuuuuuguuauuucuuuguuguug
uuguuuuccuauuuauuuguuuguuugguuggggggggguuucuuugugugauuuuccuggaacucauucuguagaccag
```

TABLE 3-continued

RNA transcripts up-regulated during HF stem cell activation.

SEQ
ID
No:Access. # Sequence gcuggnnnnnnnnnnnnnnnnnnnnnnnnnnnnnnnnnnnnnnnnnnnnnnnnnnnnnnnnnnnnnnnnnn
nnnnnnnnnnnnnnnnnnnnnnnnnnnnnnnucaugugauauaugaugaacuuagaguugguuaaguuucacagggauaguu
uacuuacauaaucuuucugucuuuaaguaagaauguuccuuuuaaaaauuguccgugccuccaauggugaugcuugggunga
ggcucauggaaaacucuauuccuccaagucagauuggagcauuugonuugaugaagaugaaagagacugcaggunaguggau
uuauuucacauuuaggaaaauuggaaugugcuguuuauuucucugcauuaauacugauuaacuucauauucuuagauaau
ggagucugaagcuunnnnnnnnnnnnnnnnnnnnnnnnnnnnnnnnnnnnnnnnnnnnnnnnnnnnnnnnnnn
nnnnnnnnnnnnnnnnnnnnnnnnnnnnnnnnnnnnngaauucaugcuccuccugcugccuccuggggugcuaaguugca
aggugauagcucagguacucacucuagugucuuucugggggugcucuuuuccaaggccucucuacauauuaagccacaaag
gagucugugccccucaagaggaugagaugugaauauuaggcuacaguuuguugccuuuuuuauuuuccuaacaug
guaccacaauugaauuuuauucuuguguuccсcagaaaauuacuugggccacacagcaaaaaaugcugugaucacaguecccug
cuuauuucaaugauucacagcgacagguaaaauuagaucucuuguugccugggaguggagguggggguaccugaguuaaagg
auggaaagauagauuuauuucuacuuucucuaggccacuaaggaugcuggccagauaucugggcuaaaugugcuucgagug
aucaaugagccuacagcugcugcucuagcuuacgguucuggacaaaucugaagauaaaguguaaguuggucagaugacguagc
auuaccugcauuuacagggguugugugugugugugugugugugugugunauuuuacuacaauuugugugggguccgugugunugu
gguacauuuguacauuuguacauggcauggauauggaugcaaagaauunnnnnnnnnnnnnnnnnnnnnnnnnnnnnnnnn
nnnnnnnnnnnnnnnnnnnnnnnnnnnnnnnnnnnnnnnnnnnnnnnnnnnnnnnnnnnnnnnaaaccagu
aguggugugunuacuaauuuuacuuguuucuguaugacaugcuuauaugauacguuaacaggcaugccacuuaagguugau
aacuacauucaguuauuaaguauuucaggaaauaucauaguuaauaauuaaacuuuugugucuuuuaauucguuccuuuguu
uuguccuuggaacuuaacuuacuuauuauuuuuuugacauugcuguguaugauuaagguggugugaaccuuugacauuuc
uauccuggaaauucagaaaggaguguuugaggugaaaucuaccaauggggacacuuucuuaggaggggaagacuuugacca
agcuuuguugcggcacauugucaaggaguucaagagagagguuaguuaccacugcuuagucaccacugguuaaggugagg
cguugggungugagaauuuugunugunugcauugcuuuuagcunugunuaauagcunuuuuauacuaaggunaacuaac
uauacuuucagauucauggguaaacuaaaccaguunuaguuaauaauaaucuuagauugggaacaaaagaccaagugacagugu
uaguagggagaagnnnnnnnnnnnnnnnnnnnnnnnnnnnnnnnnnnnnnnnnnnnnnnnnnnnnnnnnnnn
nnnnnnnnnnnnnnnnnnnnnnnnnnnnnnnnnnnnnnacuacucucucgcagucuauauaugucuccuaauccuauuuau
agacaggggunugauuugaccaaagacaacauggcgcuucagaggguucgggaagcugcugagaaggcuaaaugugaacuuu
ccucaucugugcaggugagggauggaaaaaucccaguacugagcauauuugaauaguguauucuaaauuuaccuaaugucag
uguagcucuuuacaguuuucuguuggcugaaaacuuggggcaugagcaaggucaaaggaacauugaucaguccuuucauuu
gaaugaaugaaguagauuuauggaugugugunaucuuuugccugcaugugugucuguacuacauuugugcuuggunuucugu
ggcggccagaagagggunacagaacugacaugucagugugggannnnnnnnnnnnnnnnnnnnnnnnnnnnnnnnnn
nnnnnnnnnnnnnnnnnnnnnnnnnnnnnnnnnnnnnnnnnnnnnnnnnnnnnnnnnnnnncacacugaguc
uaaauucgaucaugucuuucagucgugunaauguuacuuugagugaguaucaaagaucacgucucccaucugacgugugu
ccugugcagacugacaucaacuugccauaccuuaccauggaugcuucuggaccaaagcauuugaauaugaagcugacucgag
cucaguuugaaggcauugcacagaucuaaucaagagaacuauugcuccgugucagaaagcuaugcagguaugcagaagucag
caagagugacauaggagaagugauucggunugunggcaugacaaggaugcccaagguauggacucaugguauuucuccuag
aggaaaaaauaacaaugcauucuugaggcaaaauggcuuguguuggcugugunaggaauccaaucucuagugunu
cuuuaaagaguggungagaccagacucaccaaaaagucguuuuagucgcccugunguagcucauguaggaggauggccuugag
uucugggunaagaugcagcuacagaauucuaccuugcacacacacuuaaacccagucuggunaaagagaaguuguuaagcuunn
nnnnnnnnnnnnnnnnnnnnnnnnnnnnnnnnnnnnnnnnnnnnnnnnnnnnnnnnnnnnnnnnnnnnnnnn
nnnnnnnnnnnnnnnnnncagaugunaaaaaugauaaauacuuccuuaagauuggugcaguuguguagaauauaugaga
acuguauuuuauaaaccccuugucaugugccuucuauuucaaaugauaauccucugggaagcuagauaauuaaauucuucucu
cauuuaagugugacaguggaugagaugcucugaaguugucaaauacaaacaagucugcagucuuggauaugaaucucucuga
cuugcugucuggcaggccguauucuguuuggcuccaucagucgcccuggggugunggcuaacaggunucuuucucccugauac
uuagguncagcagacuguacaagaucuuuuugcagagccccgaguaaaagccuaaugugaggcugagccaucgg
agcugccauccaggggagguguguggcugggacguuacagacgugcugcuccggaugucacuccccucucucugggunau
ugagacucugggaggcgucuuuaccaaacuuauuaauaggaacaccacuauuccaaccaaaaagagccagguaagagccauu
cuuuuuuccugccuauuaacagucccaaguugunacaagugcuguuucaaucacuuuaugaacucuuuaaaacuuuguuuc
uaagacuauacuaacuggacugggunnnnnnnnnnnnnnnnnnnnnnnnnnnnnnnnnnnnnccuaggunuuucuacugcugcugauggac
aaacucaaguagagauuaaagugugucaggggaacgagagaugcuggagacaacaaacuuucuaggacaguucacuugguu
aaguguuuuugagucugaguaucaugcuuuuggggucuauagcuugcaaagcuccaaacugcugacauuacaggcauauug
uguauuuuuaaaagaacguuaugunacaugaguuaugaaacccaugauuuaguuuuuuuaccaaagugcuuuugugun
uucagaauuugaaauuuucaaagccugggaaauguucagacucgaagcaaugcuaacucagaagaaguuaguuuuuauccugau
uacucauuuuaaaaaacuuaauagcuacggunucuggucagcauucuacaguagagaaguuuuuauugcuguaaauucgg
gcacauauaaccaucauggunauuaacuucugaagcccagugauuucagaaagcacuaaaacuaccaccaucacuuaaaauc
ucaaggunuugaacauucagugaagauacuuguuuuaggaaacaagugguuuaguuggccugauuuggaaaugagaauacau
gggccuuucaaaggagcucacucuggauauuuauuuuagauuggaauuccccagccccucguggagugcccccagaauugaa
guuacauuugacauugaugccaaugggauugugcacguuucugccaaagauaaaggcacuggucgugagcaacaga 150X14897 Sequence below.
auaaauucuuauuuuugacacucuccaaaauaguccaccuggaaaacccgcuuuuguugacaaaguacagaaggcuuggucaca
uuuaaaaucacugagaacuagagagaaauacuaucgcaaacuguaauagacauuacauccauaaaaguuuccccagucccuuau
uguaauauugcacaguugcaauugcuacauggcaaacuagugunagcauagaagucaaagcaaaaacaaaccaaagaaaggagcc
acaagaguaaaacuguucaacaguuaaauaguucaaacuaagccauugaaucuaucauugggaucguuaaaaugaaucuuccu
acaccuugcagugauguauuuaacuuuuucagaacacaaagccaaguuuaacagcaguagaacuaaaacagaaugaaaaaggu
uugcuaauagaguaacauuaaaauacccugaaggaaaaaaaaaccuaaauaucaaaauaacugauuaaaaauucacuugcaaauua
gcacacgaauaugcaacuuggaaaucaugcaguguuuauuuaagaaacauaaaacaaacuauuaaaauaguuuuagagg
ggguaaaauccagguccucugccaggaugcuaaaauuagacuucaggggaauuugaagucuucaauuuugaaccuauua
aaaagccaugauuacaguuaauuaagagcagucacgcaacuaacaucgccuuuuagaagcauuacugugaugaacaag
uuggcugcuaccagccacagucaauuuaacaaggcugcucagucaugaauuaucagagagagcacgccuaggcagcaag
cacagcuugcugggccacuuuccucccugucgugacacaaucaauccuguacuggugunaucugaagcgcacgcugcaccg
cggcacugcccggcggguuucugggcgggagcgauccccgcgucgccccccugaaaccgacagagccuggacuuucagga
gguacagcggcggucugaagggggaucgggaucuugcagagggaacuugcaucgaaacuugggcaguucuccgaaccggag
acuaagcuuccccgagcagcgcacuuuggagacgugunccggucuacuccggacucgcaucucauuccacucggccauagccu

TABLE 3-continued

RNA transcripts up-regulated during HF stem cell activation.

SEQ
ID
No:Access. # Sequence

```
uggcuucccggcgaccucagcguggucacaggggccccccugugcccagggaaauguuucaagcuuuuccggagacuacga
cuccggcucccgguguagcucaucaccuccgccgagucucaguaccugucuucgguggacuccuucggcaguccacccacc
gccgccgccucccaggagugcgccggucuggggaaaugcccggcuccuucgugccaacggucaccgcaaucacaaccagcca
ggaucuucaguggcucgugcaacccacccucaucucuuccauggcccagucccaggggcagccacuggccucccagccucca
gcuguugacccuuaugacaugccaggaaccagcuacucaaccccaggccugagugcuacagcacuggcggggcaagcggaa
gugguggccuucaaccagcacaaccaccaguggaccugugucugcccguccagccagagccaggccuagaagaccccgagaa
gagacacuuaccccagaagaagaagaaaagcgaagggcucgcagagagcggaacaagcuggcugcagcuaagugcaggaaccg
ucggagggagcugacagaucgacuucaggcggaaacugaucagcuugaagaggaaaaggcagagcuggagucggagaucgcc
gagcugcaaaagagaaggaacgccuggaguuuguccugguggcccacaaaccgggcugcaagauccccuacgaagaggggc
cggggccaggcccgcuggccgaggugagauuugccagggucaacauccgcuaaggaagacggcuucggcuggcugcugc
cgcccccuccaccacccccccugcccuuccagagcagccgagacgcaccccccaaccugacggcuucucucuuuucccccaccaccca
uccacccucaagggugcagggugaccaagauagcucuguuuugcuccccugggccuuagcugauuaacuuaacauuuccaag
agguucaaccuccuccuggacgaauugagcccccgacugagggaagucgaugcccccuuugggagucugcuaacccccacuu
cccgcugauccaaaaugugaaccccuacugacugcucagucuuucccuccuggaaaacuggcucagguuggauuuuuu
uccucgucugcuacagagcccccucccaacucaggcccgccucccacccccugugcaguauuaaugcuauguccccucucacccuca
cccccacccccaggcgcccuuggccgcuccucguuggggccuuacugguuuugggcgcaggggggcgcugcgacgcccaucuug
cuggagcgcuuuauacugugaaugaguggucggauugcugggugcgccgggauggguugacccccagcccuccaaaacuuu
cccugggccuccccuucuccacuugcuuccucccuccccugacagggaguuagacucgaaaggaugaccacgacgcaucc
cggguggccuucuugcucaggccccagacuuuuucucuuuaaguccuucgccuucccagccuaggacgccaacuucucccca
cccugggagccccgcauccucucacagaggucgaggcaauuucagagaaguuucaggcgugaggcuuuggcucccccuaac
cucgauauuugaauccccaaauauuuuuggacuagcauacuuaagaggggcugaguuccacuauccccacuccauccaauu
ccuucagucccaaagacgaguucugucccuucccuccagcuuucaccucgugagaaucccacgagucagauuucuauuuuuu
aauauugggagaugggсccuaccgcccguсссссgугсugсaиggaacauuссauасссugucсugggсccuaggиuссaa
accuaauсссaaaсcссaсссссagсuauuuaucссuuuсcugguсcaaaagcaсuauaaиacuauuaauuaugиuауaaуаaaau
auauuaиauaugagugсgugugugugсgugugсgиgсgиgсgugсgugсgagcuuсcuиguuuсaagugсc
uguggaguuсaaaaucgсuucgggauuugagиcagaсuuuсuggсugucccuuuuиgиcaссuuuuиguugиugucuс
ggсuсcucuggсuguuggagacagucсcgссucucсcuuuauccuuuиcaagucugиcucgсucagaccacuссaacau
guсuссacucucaaugacucugaucссgunugиcuguaauucuggauuugсggggacaugсaauuuиacuuсuguaa
guaagugugacugggugguagauиuuuuacaaиcиauaucguugagaauuс

151AJ006289   Sequence below.
caccugaиuсссggaggcссgagсссиuagиcugggсggggиggcgcgggccggaaggacgссauсссggсcиgggccaиgg
aggcиccсgсaccgиcссucacggaggaggauиugacиgaagиgaagaaggaсgсuuиagagaauиииacгугииuaссиgu
gugagaaaaиcauagсugagagacaиииgaиcaиcиacgиgcaaaaaaaauacиaaguagagaagacacиgaagaaauиuc
uugсcgaaсuиcaaguagaaaacgggcиggaagиuguииagacuacuиacaggagaaccccaggggсcиggacacccиggиg
gaaиccaиccgcagggagaaaacacagacсииccиgaииcagagauиaaсggagguсиaaagсииcggaaиauaиaaaaс
uggagcacсuсaaaggcсugaagиgсagсagсиgугagсссииugсagссggagссaсcaaсaaссuсиcиaggugсaaииc
cgaugagagcaaucucисиgagaaaсagagagсauссacсugиcaиgиaссaсссggagggagagиccagсacggсисссиис
иииcисuaиggсgисgисссиgaaсuиgссagиccиggaagиuggсaggaсugaaaaсagсagсииcисииcagсcacиcиии
cиcgaссugggaccисuggggсисссcиииugсссссagaсcиисggииggaagaggggggaaguиgииggaaacисaagиg
aиaиgииcсссииaсggисacggguсииииcacgccaaиgиaиacaисaccgссиaguugииииacиaguиgaигсaaaaи
gсигугaaggaggccaисииисиaиacaaaccacgguигacagguсacиcaсaииcgauсgигcсииuaaaaисagиgгиaсa
caиисисиgиaaaиaggaииuguиaggиaaagaagсgсuсиggggсggсuggиguaaсaugguggсссgиgaсиииис
сaиaaиgсcиииcиииииаuиaииииuagguguиguсgиaиииugaaciuииcaиaagauuaаииииаисggaaиaии
исиcaaииugaaaaсaаcиuggигaauиggaauaагииииaссacииuagсиacaaaииииcигсагиииcигугииии
иисcсacиgaисиggссagиauaиииuagсagиaagсигиигugиgисaggaaagсиggасасgggaaagсиgссgacacac
исagсagиgисссacuссииagиисиgagaagccgисgggиисиgaggagacасcигуgggсacиgagссиggиgaссисa
guggcccaaaaииигиииииaисисaссссugссagсgиgaguдсиuуacиииcaсaggссиигугуссисaguciuuaисии
aaaggauguиaисииggсagggсauсacииgиaaииaaaигуgaиgaauсииgacиигугaсиgсcигсисgисиgaggсgи
uiguиcuggсиccgagagсgcиgacaиgигaagсaиggигagсagсgagggaaсигaсaggaигуggссggugсcagагуg
gсиииaгугиииgсauсaggсagcсaссagcиссaисcgугиисиuacигcиииaсaaaguигугacиaaсиииaсасaииии
uaaaaaугсugaигуиcuсgиииaaaиuaиaaииииaссиaиииcииgасаисиaaссисaиииаиииcиaииaиииaa
aaaииaagaaaigaaaaигугcиaииaacaаuaaaguuuииииaaugu 152X12944      Sequence below.
gggggggggggигсagсgссgacgисссcигсcgссaссaигсссaaaagaaaggсигaaggggaигсиaaaggagacaaaa
ccaaggигаaaggacgagccacgagagaagauсccaагигиигусиугyaaaссигсcугyсссaaagсcagagсссaaaссaaa
aaggсссcиgccgaagaaggиgagagaaggиaссaaggggaagaagggggaaagcигaсgсcggaaggaugcgaauaauccuи
cagaaaaиggagaugсcaaaacagaссaggсacagaaagсигaaggигсиggagaугсcaagигaигугугугcаигииuga
uaacигуигacиuсигуgigacигуacaguигугaaaиacиaигигугиигaиcaagиигугиauaaaaaаугсagaaииисигугиас
иgигuguuaaagсиaгуaguaигугугагсaсacagaасaсiиcaгугсаииaсguдгуggaaggсисcсугиигугcсcсaggagag
agaиссuggисиigacсиaggугggсcaсcaaggсacaaсaaигссигугугусугugggaaaасиaиaaaииcaсииииаиаис
cисиисссccигуaсиaисaacaugаcииaauiсссииaaaaссagagассаугуиггаaссигугассссcaaaaиугуиии
cссagиссauугаgиgaиggggасиииугсaгуgасиисaиугаgигугиисaaaagaгсacигугуиссиииииаиaaaagaи
ugуggaиcиисagaигугuaаииcигccиaaaagиcagggисggсигугугaaaagиугииaaaaсaacauсcииaaугугa
```

TABLE 3-continued

RNA transcripts up-regulated during HF stem cell activation.

| SEQ ID No: | Access. # | Sequence |
|---|---|---|
| | | aaugucaaccucacucuaagcuacuuccccuuuucaaagcauugaaugaagacuucauuggguuuuauaguggcuuucu gauuuugguagucauucagaagggaauuuggaaguucuuguauauuguugcauugucugcccaugccugccugaauacc augauuguuuaugaaagaaucuuaauaaagcugguuacaguuaggcuggaaaa |
| 153 | AW061302 | uuuuuuuuuuuuuuuuggaaguccauaaguaguuuauugucuucaagacuacagugugg auuccucucccagagaagggucuuucagaggcagggggacugucacccaggugcaggccgu cuacuugucauuuucauacauggcuggauucuuccuuuucgacugcucaaacucucugguu gccccauguguagaucagguagaccacuacaaacggcggcgccacgcgcaggaugcgcuc gcgagugcggcgcaacacguuggggaugccuuugcugaaauagcuugggaaggcgcgcug cucaaagggcgacaagcugua |
| 154 | U67328 | Sequence below. |
| | | caugaagccagagaugugggaagauguguguguagacugcaucaaugaacugauggauacguuggaugcacauuccaacaucucu gucggagagaacauuuuggcagagagugagaacuuacacaacuuugaucaguucacuccguguacgacgcugcauccuaacu ugguggagcgaauggaugaagaauuuaccaaaauaaugcaaaauacucacuccaagaguaugugggagcaccuga aggaugaggcacaagugugugcaucauugagcgagugcagcgcuacucuggaggagaaaggugaccacugaggagaucugccag aucuacuuaaggcgcauccugcacacguacuacaaguuugacuacaaggccaucagcggcacguuacuccuccugaaggau ccucaaagucugagcaagaccaggcagaaaaugagggugaggacucagcugugcuaauggaaagacugugcaaguacaucua ugccaaggaccguacagccgaccgauccuaccugugccaucucugccauaucuaccaucaugcgcuccacucccgcugguau caggcccgugaccucaugcucaugagccaccuacaggacaacauucagcacgcagacccgccggugcagauccuguauaccg uacuauggugcaacugggcaucugugcuuuccgccaaggccugacaaaggaugcacacaauggcacuucggauauucaguc aaguggguggugcaaggagcuucuaggucaggguuugcugcugcgcuugcaggagcgaaaucaggaacaggaaaaggua gagcgacgccggcaggugcccuuucaccugcacaucaaccuggagcugcuggagugugucuaucgggugucagcuaugcuc cuggagauccccuacauggcgcccaugagagcgaugccgccgacgcaunaacagcaagcaguuccaccaccaacugcggg uggggcgagcggcacgcccugcuaggucccuccgagucaaugagggagcauguggucgcugccuccaaggccaugaagaugg gcgacuggaagaccugccacaguuucaucauuaaugaaaagaugaauggaaagugugggaccuuuucccugaggcugacaa aguucgcaccaugcuaguucggaagauccaggaagagucucugaggaccuaccuuuuuaccuacagcagugucuaugacuca aucaguauggagacacuacagauauguuugagcuggaucuacccacuguucacuccaucaucagcaagaugaucauuaacg aagaauugauggcuucccuggaccagccgacacagacguguggguagcccguacugagcccucugcccagcaagaaacuug gcucugcaagcuggcugagaaaacuuggcacccuaguggagaauaauggacgggguguuugccaaaaacagggaaccuaugg uggcuauuccgagaccccaagggugggcuaccggaaaaauggaggcuaaaugccccgugguggcuaccccccagcaacagucu cagacaaccuccugaguucccccacuucagucacccugggacagaccaucuaaccuuuuucuccuaacucaccccaaucauua aagaucuuugaggaauuaaaaaaaaagaaagaaaaaaaaaaaaaaaaaaaaaaaaaaaaaaaaaaaaaaaaaaaaaaaaaaaaa |
| 155 | AI604314 | uuauuaauuaaaaacaauuuauugaaaaagaguagugcuuuguacaaauucccauugca gccccagauaucaacugaucucuuuccagcuuugguaguagggguauaaaaauaucaaaa cuaggugauucugauguaagauuucuauggauuauuuugagauauauagauuugugua guuuggcaaguaucauuucuaugcauuuacauuacauauuaagcacagauucuguggcaa aacaucuuugcaugauuacuuuacacacacaaauauaguaaaacuuacauaguacaaauu cacauaagacuccauucugucuauaacuauccaugugguuuuaccagaauuauaauu cuuaaccucuccauaacugucagcuuccauuuaauuuugaaaguauacuucacaaaga gcacuucauuugcuuuuagaguauacauagacu |
| 156 | AI845121 | cggccgccaagaaguauaacaugcgaguggaagacuacagagccauaccccgaugauggca ugggguauggcgacuacccgaugcucccaaccgaucacgacaugagagggaguccguggu aucaguggggaccacucagaacucaggaugaacuggggugaaccgauacacugggaccuag acauguacaucaggaaucguguggacacgucacccccugugucccugngaugucaugu guaaacaucucuucggcuuuguggcuuucaugguuuucaugugucugggauaggggcacugugu ucccuuccuaccagccuguggguccgaagcaguaccccuuacaaaaaucuguaccuggagcg |
| 157 | AW047756 | uuuuuuuuuuuuuuuuugaugcaaaugucuuuauuuuccacuuaaacaaguuucccuuuu gcacuggccuguggcacaaaacagauggcugggguggugacauuaacugucaaguuaguga gaugcagaugguggagacacugcauuugagugcauaauacuuuuauuccagaggaacgc caugcagcccaguuacaccuuuaggucagaaaggcugaugcgugaccagccucuauugcc ucccuugguaagaaggacccacaagugcagaguccaacagaugcuggcucagaugcugaac ucaggggcauuccaauuaccacuuucuucuuccaccuacacagggccugcucagaugucuu uuuacaacuccauaagcccuuuggccaaagucccgcugcagugguugggggaggaccuucca cccuuccaccagucagugucugaucuggugggag |
| 158 | AI838021 | uuuuuuuuuuuuuuuaauaucuguaauaguuuauuucaaagauuugacauuuacaagu agaggcaccacaugcuacugacaguaaauacugcagggacugaaggccaaggagagag auccacagaagacaggccuguagugcaggcauugcaucgaccuugcccacagugcuuugu ucccaacucaggacaguacuuuagugcuugcuucauuuacuggaaaaguucacuggacau aguuccacuucuccccacagcuuccagcucagcaaacuuaagcuacuacuccucgau gcucucauagaggcucuugauuugugucuggaagaacuuggcaagcucuacucguuuggc uuucagugucgugucagaaguccguuuucaa |
| 159 | AW122893 | uuuuuuuuuuuuuuuucugaggauauaaaaauaucuagacugauuuugccaaaauguaag agggagaaaguuccugaagacucugacuacuugcuuauuuugauugaccuucuaugcuu augucauuacugccucacaacguguuugaugccuuuaaugauacaaagugagccugugc cuucauuuucuugcccauuuugguaccccucgugccg |

TABLE 3-continued

RNA transcripts up-regulated during HF stem cell activation.

SEQ
ID
No: Access. # Sequence

160 M59821   Sequence below.
gcgcccgaacgucuagcagagUaccugcugcuguaagcuugucgucugggcugcaccgcccgucuuaacccauucucgacuu
aacuacucucgucgaacaagcauggaaguacagaaagaagcgcagcgcaucaugacucugucgguauggaagauguaccacu
cucgcaugcagcgagguggcuugcgacuccaccggagucugcagcuaucccucguuaugcgcagcgcucgagagcucuaccu
cucagccaagguagaagccaccagcccgaguucccgccaucccgcagggcucuugacccucgccugcacccgccgcgggaag
ccgaaguugcaguggaaguagcgucccccgaagccgugcagccuccggagcccauggauacgcaagaggaagugcugcgagu
ccaggagacccugcgcucugugacccgcccccgcuagagucagccgcaagcgccggagcagcagcgauuugagcgacagua
gugaugccggacugguaccaagcaagaaggcccgucuagaagaggUggaggggggaggcgacgucggagguucccgaucgcc
ugcagcuuccuccggcacaaagcgaaggugccuucccuaaccucgcccgcguccuccaaaggcgcuucuccagucuccugaac
uguggacccgccgugccccgccgacgcccccacgugcgaggccaagccagccugccgccggccgacaauaugcucaacgu
gcuggugcgagcugguggcuucugagagcucugguggcuucuuucgagcggcgccaccggagcggagaacgcacaccc
gaggcgaaggccggcggggccgugaagaagagccgcggcccgagcugccgagaggcagggcaaggacugaggagcgaggg
gcgcgggcgccuucucccagacgugcguccauaggugcuauuaaaggacugucccuuccuuggcuuggagaagggacaccu
agaucuugaaucucagggucgaacucucuaggggccaggcugcccuuucaaggccguuucacuaccauucgcguuucggcc
ccuacaagugggcacgcuuugucaagcggucagaguugcgucauggacagacgcggggucuuccuguugccuugcgugg
ugugggccugggaggaggccagggugugacccgcccuagggacugggaagugacuugagucaccucgcccccacaggcu
gcugugggugagccugaacugaaccaaucaaaucugcgcagaguugaaguggcuggagaccccgggacuggucaaccuagau
gaucgccuggcgugaccaccgcgggacgguggggccgcuggucguaguugcugccguagacacagcuucucgggcagga
aagaaaauuuuuuuuuaccagcguguuuaagaaagucuguuuacuuuucccacgguggguuguuuaauuagcaacuaccu
ggaguuuuacaaugucagcuaggaaaaauaaagaccaucgugu 161 M13805   See above (same Accession Number).

162 AI845886   uuuuuuuuuuuuuuuuugguuccacuuaaguugcauguuuuauuucucccaaucccagca
auagcacagaagcccaucaugccaucccagacugguuucuaguaggcugagaugacagg
gagccucaguaacgcuaauggcacagagggcucccaaaugccaggcacaacugugccucc
acacuggugacugcccagagugcccuggccccagugugUuggcacucagucugacuuuac
aacgcaaccugcaccuuugaaagggacagucugggagugggagugugagggagugaagc
ucaaacugccuccugucagcucacccuuucaacauuaaacagagaccaagagagaaacag
uuccaauauuucacauauauuucuucuugugcagucuaagccgagaaugccauguaaaug
ggucacugcgaaaugcagcaauuuagu 163 X53157    gucucgggcgagauggcuucaagguuacuucgcggaguggggcgcuuuggcggcgcaggcc
cugaggcgcacggcccgguggcgcggccgugacccgcuccauggcuucuggagguggiguc
cccacugaugaggcaggcuacuggggcuggagagggagaucauguagcagcacagaag
ggacuggacccauacaauaugcuaccuccaaaggcagcuucaggcaccaaggaagacccu
aaucuagucccguccaucagcaacaagaauagugggcugcaucugugaagaggacaac
uguacugcaucuggUuuuggcugcacaaaggcgagaggUcagcgaugccccaacugugga
acccauuacaagcuggugccccaccaaauggcccacugagccccugugUuaucuuuucag
aauguaaagaaaaacuucucucuaauaaagacuagccauugcaccugcuccuccc 164 U19118   See above (same Accession Number).

165 AF062071   Sequence below.
gcgcaccgccygyguygcgcgscagcgucgucgucuaggugcaucgcgggcccccgcagrwagaaaaauauggcucaggagacua
accagaccccagggcccaugcugugaguacaggaugUggcuuuuauggggaauccuaggacaaaauggaauguguucuguuu
gcuacaaagaacaucuucagagacagcagaauagugcagaaugagcccaaugggggacagcuagUggUuccaacaguccuac
cucagauucugcaucuguacagagagcagaugcugguuuaaacaacugugaaggugcugcuggcagcacaucugaaaaauca
agaaaugUgccuguggcugccuugccuguaacucaacaaaugacagaaaugagcauuucaagagaggacaaaauaacuacccc
gaaaacagagggucagagccaguugucacucagcccagUccaucaguuucucagcccaguucuuccucaaagUgaagaaaaa
gcuccugaguugcccaaaccaaagaagaacagaugUuuuaugUguagaaagaaaguuggccuuacagggUuugacugccgau
guggaaauuuguuuuguggacuucaccguuacucugacaagcacaacugUccauaugaUuacaaagcagaagcugcagcaaa
aaucagaaagaaauccaguuguuggcugaaaaaauccagagaauauaaauuacuacauugUgaagagacugaaacuuuu
guuuuauuuaauaUaucguaggaaaacauuaaagagcagaugcauggccauuuccuuugauguuucccagaguuuugc
uuuauacuugucugucauauaaauugaucuuuggUguuuuucaggcagauagauagauacagccccu
acaaaugUauaugcccuccccucaguaaaauuggacaaaaaauugcacaacaaauugaaauacauuaucuaggaacaaaau
uuaguuccacgugccaaacuaaaggaaugaaaucucugcauguuugcagcauaucugccuuuugggaauguaaucaaggua
uaaucuuuggcuagguguauugugccuuacuuaaaaaaaaaaaaauugUacaccagaaaaggacuggcagucuacuaccaua
gucaaacuucaccuuaauuucgacaugacuuuuggaagcaggaagaaagcuacaaaacugguauuuggUaccaugugugagc
cuggUuaaauuggucuuccuaaaaagcuguacaaauuaggacauucgcgaaggcaacaccagaaaucugguucaaagUcaaaccau
caagcaacagcagggugccUgauaaucuuggaagcuuauuugugcggcccugcaccagaagauaaucgcauucucauuuc
uaaaauuguagcacagaacugcacuaggauuuuuuacaaggagaaauuaaacucuguuuggUuuucacauauagcagcuc
uguuuaaauaacaugcaucugaauuuuuaaguugcaaggUaucugaacaguuaauuuucaugUgcaucuuuuguugaaugu
uuugguucaagaaagaauguuuaaagcuuuuuaaagacuucaguucuuaauguaacuguacccuucgUcauggaaaaucau
aaccaacauggcugcaguagacuucuuuagugguauccagcaccacuugcagagggcugcuuuaucauauuguacuggggu
guaggacucuaguguucuuggguauauucacuucuguuaaaauggaaggUuuuugUgauguaugaaacuugUguuu
uacuucacugaugcuugucugguauauucacuucuguuaaaauggaaggUuuuugUgauguaugaaacuugUguuu
uuauauauaaaugaguauaguagauuaguguugugUaaugccuguuucaucuguaaauaguaauguacacaaca
aggcacuacuucugauuuugcaguguucaguccuaguuuuucuuuauuaaaacauugaguuuugcuucaauuuuauga
ccuuaguucuaaguuagauuugcagauguguacagauaguucauauuuauauugcacauaaucaugcuauucagcauug
auguauauuguauuauguaaauaauaaaagcaguguacagagggaaaa

TABLE 3-continued

RNA transcripts up-regulated during HF stem cell activation.

| SEQ ID No: | Access. # | Sequence |
|---|---|---|

166 U10404 augacagaugccgcuguguccuucgccaaggacuucuuggccgguggaguggccgcagcc
aucuccaagacagcgguagcacccaucgagagggucaagcugcugcugcaggugcagcau
gccagcaagcaaaucacggcagauaagcaauacaagggcaucaugacugcguggucgu
auccccaaggaacagggaguccuguccuucggcgugggaaccuggccaaugucaucaga
uacuucccacccaggcucucaacuuugccuucaaagauaaaauacaagcagaucuuucug
gguggugguggacaagaggacccaguucuggcgcuacuuugcagggaaccuggcaucaggu
ggugccgcuggggcuacauccuugugcuuuguguacccucuugauuuugcccguacccgu
cuagcagcugaugugggcaaagcuggagcugaaagggaauucaaggccuuggugacugc
cugguuaagaucuacaaaucugaugggauuaagggccuguaccaaggcuuuaauguguca
guacagggcauuaucaucuaccgagcugccaacuuuggaucuauugacacugcaaaggga
augcucccagaucccaagaauacucacaucuucaucagcuggaugauugcacagucuguc
acugcugucgcuggccugacuuccuauccuuugacacggucgccgcugcugguaugaugaug
cagucuggacgcaaaggaacugauaucauguacacaggcacgcuugacugcuggcggaag
aucgcgcgaugaagggagcaaggcuuuuucaagggcgcauggccaacguucucaga
ggcaugggggcgccuuugugcuugucuuguaugaugagaucaagaaauacacauaa 167 U07634 Sequence below.
cguagaaguugucucugucggcgggcgggcaggauuggggcaccgagaccggcgugcggacagcaggacgcgggg
agcgagggcgtgcggcaugcgagagccgggcagucgguuucugccuggcgcugcuguggggttgcgcgcuggcggccgcggc
ggcacagggaaaggaaguuguuuguuggacuucgcagcaaugaagggagagcucgcgcuggcucacgcaccccuauggcaaa
gggugggaccugaucagaacaucauggacgacaugccuaucuacauguacucggugugcaacgugguauccggcgaccag
gacaacuggcuccgcaccaacugggtguguaccgggaggaggccgagcgcauccuuuauuggacucaaguucacggugcgagacu
guaacgcuuccgggguggcgcccaugccugcaaagagaccuuaacuccuacuaugcagaguccagaugagcuauggca
ccaacuuccagaagcgccaguucaccaagauugacaccaucgccccugacgagaucacggucagcagugacuucgaggcucgca
acgucaagcugaacguagaggagcgcauggugggcccuuacccggaagggcuucuaccuggccuuccaggacaucggcgc
cugcgugcggcugcucuccguucgcgcuacuacaagaaguguccccgagaugcugcagagcuuggccuugccucuucccggagacc
auugcugucguguuuccgauacacaaccccuggccaagcccaugcaaaguagaacuggcguggugcccuuauggg
ggcgaggggcucucaucagcacacugcacgguggauggcgaguggcuggugccauccgagugccguggcuaggcagga aggcaggucgag
aaggucgaggaaugccugccgagccuguucuccaggauucuucaagucugagggcaucgagaguccccuccggugggcagucca
gagcauaccugccauccacagagggaagugcaccuccugccagugugaagaaggcuauuuucagggcaccugaggacacccugu
ccaugucuugcacacgcucaccucugcccuaacuaaccacggccagcaugaguagaaacugcguuggacagc
ucccaaggacacugguggccgccaggacauugucuacagugucacuugaacagugcugcgcagagucuggcgaguguggg
gcccugugaggccacggugcgcuauuucagaaccuccucacgcccuggaccgcacgaggugugacaggucagugaccugggagccc
cacaugaacuauaccuucgcugucgaagcacgcaauggcgucucaggccuggugacuagccgaagcuuccggacugccagcg
ucaguauuaaccaaacagagccccccaaagugaggcuggagggaaggacccaccccugagugugcaccaggaggagcacccg
ggucacagcagacgcgugugugaaguacgaagucaccuaccgcaagaaggggaugccaacagcuauaauggccgccgca
cggaaggcuucuccguggaacccggaugaccuugccuccggauaccacguaccuggugcaggugcaggcaugagacgcaggagg
gccaaggagccggcagcaaagugcacgaguucagacgcucuuccacggaaggaucucgcaacauggcgggtugaucggcggugu
ggcuggauguguguucuucuggaaucgcaggagaguuggcucuucauccaucgaaggaggaggaaccugcgggcuc
gccaguccucugaggaugauguccguuuuuccaagucagaaacaacuaaagcccccugaagaccuaugaggauccucacacuuacga
agaccccaaccaggcuguacucaaguuuaccaccgagaucaccccauccugugugcaaggcagaaggucauuggagcagga
gaguuuggagaggucuauaaagggacgcugaaggcauccucggggaagaaggagauaccggugggccaucaagacacugaaag
cgggcuacacuggacaagcagcgggugggacuucgugaggcgaggccacgacauggcgcuuuagccaccacaauaucauccg
ccuggagggcgguggucucaaauacaacccaugaugauaucacagaguacaugagaaugggagcgcuagacaaguuccuu
agggagaaggaugugaguucagcguacuucaguugguggcaugcugagggauacgcaucggcaugaaguaccuggcc
aacaugaacuacgugcacagagaccuggcugcccgcaacauccgucaacaggcaaccugguuggcaaggugucccgauuuug
gccgucgcguguggggaggaacccccgaggccaccuacaccaccaacaugggcggcaaaguccuauuccgaggacgacccc
agaggccauuucuaccgcaaguucuaccucagccagccgaugugguggagugcauugucauguggaaggaugacuua
uggcgaacggcccuuacuggaacugucaaaccacggacgcaugaaagccaucaaccgacggccuucggcucccacgcccaugg
acugcccuucagccauuuaccagcucaugaugcagugcugcagcaagagcgcucccgccggccaaguuugccgacaucgu
uagcauccuggacaagcucaucgcacgcccccgacucccucaagacgcuggcugacuucgauccccgagugauccggcug
ccagcaccagccgcuguggagggaucccccuuccuguacgguguccgaguggcuggagagcaucaagacguacacgcagg
aacacuucauguggucuggcuacacgggcaucgagaagguguacagaugccaacgaagaacaucaaaaggaucggagugcg
ucuuccuggccaccagaagcgcauuugcuacagccugcugggacucaagaccaggucaacacaguggggauuccuaucuga
guccauuggggcugucacacaauacuugaagagccacaguggucucccugccgaucggugcuggcccacuggaacuuuau
uuauuucuguuuccugcuauagccuccuaggacucugcagggguacuucugcagguucagugggaaacuu
ggauugcuggucagggcucucuuucccugaaaaggacccagucuaagaacuuagcaguuucauggccuucccagcauccc
cugaggcuaaaguuccaccaagagucgauaucgacgagggacauuuccaacggaccuccccaucuucauuuggccuccuga
gaagccacucugagcugaggcuaagcacuaagcccaggaccauaugacuagcacuguaccgcccgcccccuaguuagaggu
agguuugagcuggcgggguugguguggcacaagcaaacuccagucccuuuacaagacacccugcccuccccgucgagg
gccagccuucuugcuuccuaggccctuucaggaugcuugcgcugcugaggguuuuauaaauauauauuuuauacuug
cggaaagaaugagugugugggcagggcacuugccagggcgggagacagaggaucccuugcaacaagacauucccggcggggg
gcugggcggaccugcaggagacuuuccgccaccaccccgucuccagccccuuuggacaaugucgcugucagguguacagauu
ucuuuuauugggguuguuuuuguuguuuuuuuugaaccuuaacuuauuauuuuuuuauauuuauuguuagaaaug
acuuauuucugcucuggaauaaaguugcagaugguuca 168 X04663 Sequence below.
ccaaaaaccuuaauuucuugcuuggugccuacauugaaccaccaaaacaauuauuucaguaaaccguagccauga
gggaaaucgugcacaucaggccggacagugugggcaaccagaucggugcuaaaguucggggaggucauaagcgaugaacaugg
caucgaccccaccgguaccuaccacggugacagcgaccugcagcuggaccgaaucucuguguacuauaaugaagccacaggu
ggcaaguaugucccucgagcuaucuugguggaucuagaaccugggacuauggaucccguucgcucaggccuuuuggccag
aucuucagaccagacaacuucguuuucggucagucuggggcaggcaacaacugggcuaaaaggccacuacacagagggagcug
aguugguugacucugucuuggaugugggucggaaggaggcggagagcucgugauugccugcaaggcuuucagcugacccac

TABLE 3-continued

RNA transcripts up-regulated during HF stem cell activation.

SEQ
ID
No:Access. # Sequence ucacuggguggaggcacuggcucuggcaugggcacccugcucaucagcaagauccgggaagaauauccugaccguaucauga
auaccuucaguguggugcccucgcccaaagucucugauaccguggucgagccuacaagccaccugucuguccaucaguu
gguugagaacacggaugagaccuacugcaucgacaacgaggcccucuacgacaucugcuuccguacccucaagcucaccagc
caaccuacggagaccugaaccaucucgucucggccaccaugagcggcgucaccaccugccuccguuccggggcagcuuaau
gcugaccuucgaaagcuggcugucaacauggugccauucccacgucuccacuucuucaugccuggcuuugcccucucacca
gccguggaagccagcaguaccgggcccucacugugccugaacuuacccagcaggucuucgaugccaagaacaugauggccgc
cugcgaccgcgccacggccggucaccacagaugcgccgucuuccguggacggauguccaugaaggagguggaugagcag
augcucaacgugcagaacaagaauagcagcuacuucguggaauggauccccaacaaugucaagacagcugucugugacaucc
caccgcguggccucaagauggcaucaccuucauggaaacagcacagccauccaggagcuguucaagcgcaucucugagca
guuuacggcuauguuccgccggaaggcuuuccuccacuggacgggugagggcaugacgagaugggagucaccgaggc
ugagagcaacaugaacgaccuggugucugaguaccagcaguaccagaggucgucggaggcugugaggaagagguggaacgag
gaggcagaagaggaggccuaacggcagagagcccugcaucagcucaggcugcuuagaucccucagccuuucuccaacugccc
uuugcuccagucuuuucugcugccucucugucuuguauugucuuuugcuucguuuucucauugggguaaauggugcc
uggcacauggcaggcacucaauaaauauuuguuugugg 169X61232   Sequence below.
ggcagacaaaagaggccggcagugcagcucgcgggacgcauggccgggcgcggaggacgggugcugcuggcgcugugugcc
gcgcuggguggccggcggguggcugcugacgcgugaagcccaggagcccggggcgccagcggcuggcaugaggcgccgccgg
cggcuccagcaaggacggcaucuccuucgaguaccaccgcuauccagagcugcgcggaggcgcugggucggguauggcugc
agugcaccgccaucagcagaaucuacacagugggcgccagcuucgagggccgggagcuccuggucaucgagcugucugacaa
ccccgggguccaugagccgggugaaccugaauuuaaauacaucgggaacauggcauggcaaugaggcgguuggacgggaauu
gcucauuucugggcccaguaccuguguaacgaguaccagaaaggcaauagagacaauugucaaccugauccacagcacccga
auucauaucaugcccccuugaaccccgacggcuuugagaaagccgcauggcagccgggcagcugaaggacuggguugugg
gccgcagcaacgccagggaauagaucugaaccguaacuuccccagaccugacaggauguauuuaaugagaaagaagg
cgguccccaacaaccacucgcugaagaaucugaagaaaauuguggaccaaaauucaaagcuugccccgagaccaaggcuguca
uucacuggaucauggacauucccauuugugcuuucugccaaucugcacggaggagaccuuguggcuaauuacccauaugaug
agacacggagcgguacugcucacgaauacaguuccugcccugaugacgcaauuuucaaagcuuggcucgcgcguacucuuc
uuucaaccagucaugucugaccccaaucgaccucccugcugcaagaaugacgaugacagcuuugaugauggaacgacc
aauggugggugcauggacagcguccccgguggaaugcaagacuucaauuaccugagcagcagcaacugcuuugagaucacug
uggagcuuacguguggagaaguuccaccgaagagaccucuaaaagcuacugggaagauaacaaaaacucccucaacuac
cuggagcagauacaccgaggguguuaaagggguuugucgugaccuucaggguaacccgaaugccaacgcaaccaucucugugg
augggauagaccaugaugucaccucggcuaaggaugggauuacuggcgaaucuggcuccuggaaacuauaaacuuacag
ccuccgauccuggcuaccuggcaaucacaaagaaaguggcaguccuuuuagcccugcuguugggguggacuuugagcuug
agucuuucucugaaaggaaggaggaggagaaggaagaauugauggaguggguggaaaaugaugucagaaacuuugaauuuuu
aagaaaggcuucuaacuaauugcuuucaucuaucuauagacuguaguaagaugcaauguggcucuuuucuuuuagguugug
ugcaguugauauuuaacauugauuuauuuuugaucauuaaguuaacauaaacaccccggacagaaaua
uaaugcuggacaucuucauucuacaucaacauucgcuuaaaaucauucgaagccucuuuuaacguaauggguagacaaugucac
uugacagaugcaugagagucacgauauagcugacugugacccugcacugcaaucacauaguuccauauaaguugccuuagu
cucuugugcugauucacugauaaagcaugauccuggaaugcacuuuggauggagaaaaauguacgugcuuuucagaggg
gcucgaacagaaugaaaaaccuaguucuugcguguacuuugaagaauggaauuguauuuagucagcuguuaagccacuuca
gaaguuuggggguuuugucuugauuguagauugg 170X14309   Sequence below.
gccacggacgccucucugaacgggaucaggcaggauuagagcugccucacugacuacaggccgugucgugucaccguuuc
ugcaggcaccaugagccaggacaccgaaguggacaugaaagaugugggagcugaacgagcuagaaccggagaagcagcccaug
aaugcagcgacggggcggcggccggggagaagaacggucugguaagaucaaggugggcgaggacgagacggaggccggg
gucaaguucaccggcuuauccaaggaggagcuacugaaggugaggcggcagcccuggcugggugcgcaccgcuggcgcug
cugcugcucuucuggccugguuggcugggcaugcuggcgggcgccguggguuaucaacguucgggcgccgcgcugccguga
gcugccuguacagaggguggggcacaaggggcgcccucuaccgcaucgggcgaccuucaggccuuggggauggccgggauggccggg
aggcauagcuggucugaagagccaucuggaguacuugagcacccugaaggugaagggccugguguuaggcccaauucacaa
gaaccagaaggaugaaaucaaugaaaccgaccugaaacagaauuaaucccacuuugggcucccaggaagauuuuaaagaccuuc
uacaaagugccaagaaaagagcauucacaucauuuuggaccucacucccaacuaccagggccagaaugcguggguuccuccccu
gcucaggcugacauugagccaccaaaaugaaggaagcucugaagaucugcaggacgguguggaugguugccauuuc
cgggaugugggaaagcugaugaaugcacccuuguacuuggcugaguggcagaauauccaagaacuuaagugggacagg
cuuuugauugcaggggacugaguccucugaccugcagcaaauugucaacauacuugaauccaccagcgaccugcuguugacca
gcuccuaccugucaaauuccacuuucacugggggagcguacugaauccuagucacuagguuuuugaaugccacuggcagcca
auggugcagcuggagugugucgcaaggcagacucucgcagacuuuuaaauccggcaucuccgacucuaccagcugcug
cucuucacucugccagggacuccguuuuuagcuacggggaugacuuggccuucagggugcccuuccuggacagccugcg
aaggccccacucaugccguggaaugagccagcaucuuucacaucccaagaccguaagccucaacaugacaguaagggcca
gaaugaagacccuggcucccccuuacccaguuccggcggcugagugaccuucggggaaggagcgcucucuguugcacgg
ugacuuccaugcacugucaccacugaccucucuccuacaaugacacaggaacagaaugagccuggagcguuaccuggggug
cucaacuuccgagauucgggccggucagccaggcuaggggccuccaaccuccccugcuggcauaagccugccagccagcgcua
aacuuuugcuuaguaccgacaugucccggcaaaagccgugaggaggacaccuccugaagcuggaaaaccugagccugaaucc
uuaugagggcuugcuguuacaguuccccuuugguggccugauccuuccuaugcagaaccuaccacccuccuuuguucucccc
aggccuuuuggauucuagucuuccucuccuuguuuuaaacuuuugcagauuacauacgaauucuuauacuggguguuuu
ugucuucaaauaaaaacaucaccccugccucaug 171U42386   Sequence below.
gncuuaagccncguuuauuuuugaugncceguuggcucagunaugnccaagaugccnauuguuuuugcccnaaauaaauuu
acuugaacuugggcuaaaaccaaaccuuggcacacaggugugauacaacuuaacaggaaucaucgauucauccauaaauaauau
aaggaaaaacucaaguguuagccugucuuaaggcuuuugauacuugcagauugggaaaacaaacaacaaacgucuugaag
cauauuaauggaauuaguuucaaugugggcaaacuguauuaaguaaaaguucugauuugcucacucuauccggauaggu
auuuagaaccugauaauagucuuuaaacaagccauucagucaugaugagguugauguauggauacaugcaucauucaaagc
acguucucaaaguuaaugcaaguaaauacagcaauuccucuuucaaugauuuaggcagaucguuaacuaugagcuagccaaa

TABLE 3-continued

RNA transcripts up-regulated during HF stem cell activation.

SEQ
ID
No:Access. # Sequence uguggggcauguuauuacagggaaaguuuaaaggucugauaacuugaaauagguuuaggagaauucaucuacuuagacuuuu
uaaaugccugccauaaaaaauugaaaugguagaauggcugaccacagcaaugaccagcccucaccuagggcucuggaugauu
uuugguucuaauaacgcaugcuaguguuugaugcuuuuuggucaagaugggaaugaacaggaagaauuaugcagcaggcuuua
uuuuaaaugccgauucacauuacucuguucaagcugcguugagauguuaaacuggcuuacuauagacuuuguaaaaaaaaa
aaaaaccaaacaaauggcuccagaagaguaacaaacugaaaucgagaucacacagguuggaaauaguacauaacugaacaa
ggugucaauucugcucuacagugcaguuuagucaguuuaguugcauagguuuccauuguuuuuauagucuguuuaugcu
aaaucuggccaaagaugagcauuguccaccacuaaaaugccuaugccacugggaauucugggiuuaaauuuugugaccagaaug
cagugaucaaaaauguucaaucuuuuuacaguggcauaggaagauggcaaaaauuuccuaaagugcaauagauuuucaagug
uauugugccuuguucuaaaacuuuuauuaaguagguugcacugacaguauugaggucauuuguuauggugcuauuucaau
uagucuagguuuaggcccuuguacauuuggcccauaacuuuuuacaaaguacuucuuuuauugcacauucagagaauuuua
uauauaugucuuguguggcguguccuuaaacuuccaaucuaauuuugucuuggagauuguuugaacgcagcuugucuagg
aaagggauggggacuagauucuaaaauuuauuugggaccauggggaauggauaguuuggaagaaacuuugcacacgacagauuu
cuagauacuuuuugcugcuaguuuaugaauauuuauugaacauuuugacaaauauuuauuuuuguaagccuaaaagug
auucuuugaaaguuuaaagaaacuugaccaaaagacaguacaaaaacacuggcacuugaauguugaaugucaccguaugcgu
gaaauauauauauuucgggguagugugagcuuuuaaguuaaguuuuuaucagcaagcaauauuuucaaauuaagcagacccggca
uuggcguguagccauaacuuucugauguuaguaaaaacaaaauuggcgacuugaaacuaaaucaugccaagguuugauacac
uugcucuagauauuaacgaaacacuuccaaacacugauacaaaguguccagauucucgaauguuuguugugugaguuuug
uuuaguguauuuuuuuucagugaaugucuggcacauugcaauccucaaacaugugguuaucuuuguuguauuggcaua
uucagugacuuguacauucagcaauagcauuugagcaagsuuuaucagcaagcaauauuuucaguuuauguuuccaaauuaa
gaauggguuuaaacuugcugaauguaaagauuugacccucaagucacuguagcuuuaguaguugcuuauuguauuaguuua
gaugcuagcacugcaugugcugugcauauucugguuuuuauuaaaauaaaagttgaacugcacagucuccuuuguuguugu
caaucuggguuuacuuuuagagggugaaaauaaaguugugcucuugccucgugccaauaugucauaacugnacaagguguc
aaucugcucuacagngnagguuuagncaguuuuagungnauaggucucaungnuuuuauugngncuguuuaugcuaaaaucu
ggccaaagaugagcauugcccaccacuaaaaugccuaugccacuggaauccugggvuanuuuggngaccagaaugaaguga
ncaaaaugccanucuuuuuacaguggnauaggaagauggnaaaaauuccaaagugnaauagauuuccaaguguuugu
gccuggvucaaaacuuuunuaaguaggugcacunganaguauugaggncauugguuuauggugcuauuuccanuuagu
cuagguuuaggcccu 172 U51126 Sequence below.
cucggucuccaagaugguggcuaacaaaacgugaggccuagagguugauccuaggucacuggaagcaugaccuugaagagg
acuauggggcaucuggguucuucccucuucuacuuggccacgagguaaccggcuucuuguaccacgugugcucaccucuacaa
ucugucggauacagacuccaagcaacuaggcuacccagugacaggcuaaaaacuacagcucuaagcucuuggaaggcgauu
ccauggaccaggaugugggaaagcccagugccgauucaccagccaaaguugccuaagcaggccagggacgaccugccgagacac
aucagccgagacaggaccaaaaggaaaaauccagaggacucguguggguagguggacguguaaaggugacaacgucaaccacggcaaugugc
gggagacguaccgauaccugacggacaucuuccaccacccugguggaaccugaaguggagauucaaccuguugaucuuugucau
ggucuacacagugacguggcuuuucuuuggaugaucugggucgaugauugcguacaucgggggagauauggaccacauaga
ggaccccucguggacuccuuguguaccaaccucaacgggvuuugucucucuuuuuauuccucauagagacagaaaccacc
aucgguuauggcuaccggucaucacggacaaagugccugagggggauuauuccucucuuuaauccaguccguguugggggucc
auugucaacgccuucauguaggauguaguuuugugaaaauaucccaacccaagaagagggcagagacccuggucuuuucca
cccacgcgggugaucuccaugcgggauggguaaacugucuugaugguccggugggggacuugaggaaaucucaacauuggugg
aggcauccaucagagccaaguugaucaagaccccaaacagacuucagagggggaguuuauucccucaaccagacugauaucaac
gugggguacuacacagggggacgaccggcucuuucugugucaccauugauuauuagccaugaaauuaaccaacagagucccu
ucugggagaucuccaaagcgcagcugccuaaaagaggaacuggagauuggucauccuggaggggaaugguggaagccacag
ggcaguucugaaaucgaaaucaagcaggguucuauaagaacaccuggagaccccaagcgcuggaucuuugggguccaugaa
cugcuuuauuugcugcaaucaaaaaugcuagucgcugaucugauaggagaggaaacgagacucagagcguggaaggauaaca
cgcugagggcugauuucauacacucuucccggcuggaucaucccagcccccacagcguccaggcuuaguuucuuccuuugu
uuuaacaaucuauacuuccuccagccugggcgagcuaguauacccagagguugguuuuguuucuuucagagcuguaagcc
cagugcccagugaccucaucuggggaggagaguuuaagcaauaagaccugaaaugcuaaaacucuggggguagaaaaccucugcag
agacagcgucugggaaggcucuacagagacagaguaggggaagucucacgaagguucagagucucauucuauuccuggaga
aauccgcccgquccguucagugccgguuucaacuccucugccaaagacuucuuuccaagacacugguaucagcuauccagca
guaacuuuggcaguauauaaaucaauggcacugccccauaaaacccguugaguaaaaccuauggucuucaacagcuggggga
gccguagcccagcuccuguguaggguaaggcuguggagaccaugccugcucaccuccucguugaaaagcaaaacacugua
agaaaccuaacaugacuuuuccaacauuuccaggcuggggagaagacuuggcacaaaagagcuuggagguucuugaucug
gaucccuagcauccauggaagaaggugggcaugaucacccacacuccucaucccauagcucugauagagguaggcagauucc
uggggcucaccagcucauccuaacagccagguccaaugagggaacucuacaaaagaacaagagguggaucucugagaagcg
acacccaagcuugaccucuagcccccuguacacaccuguuaagcaccgggcaucggggacacacaccucgcaauuugcaaacaag
gcaaauucucacaucuagaagggcacaagagagaauccauaagcucaaaaaguuaagggccaagauuugaccaaauuaauggcuu
gggguugaaaagacuaaaccacuggauagaauguucauuacuaaaaacaccuuccugaaaaguauuacugcucuucuuucug
caacuggaccaugcagagauccacaaagagaugccccagagauuauuagugauggucauaugauauacacaauguggacucua
agccaaggcccaucaacucagauccagaggcugacagugugcuuaucuuagagauaccacaguggcugccuaaucaccacg
uccuuaagucaggggagaguuuauuauuuccuaugaaacaccgaguggggacuuaccaaugaagcaaccaaccugac
aauccuaaccacccagaagaggaucucgggggaaagcaugaauuauuuacguugcaacaugcacacuccggccacgcag
cucaacagccaggagugcuuucuccacuuagcccugcccuggcaaucaauagcaugaucucgucuguuguaauuacccagcu
agcuuuuucucaaaaauaauaaucucccagccauagaccuacucaucuguguccucuuuaauuucaacccacaguuacauca
uucacuggcuugcucaguuucucaacucugaaauggggaaugaugaugaugcucuuccccccaagccaccaucucccc
cgugaccuuccuaguacagacucaaaccagggaagauuauuuccuucauaggccacagggugaaaugcaauaaagaaca
aagccuuguagggaggcagagggaaagaccagccucacaagaggcuccauugguuucagggacuuugaagcuuggacgaaa
ugucagaugaucccccuuugaaggugcuccaaagaagucaaugugaaaaauauuugacugauguguugcccguccacaagccaagg
ugccucugcccugguccuaccaugaauuauaaacuggagauauauuugaagaaucaucuacaugccugcaacgguggccgugaauguagauuccccggcucu
ucugaggccacugaggacagggcaaacuaccucugagaauggaggcucacguuucugcauccacuucaaaauguuccauga
auuuuugagacaucucccauaccccuguagaaauucaaccuugugcuauuaaccaaaucauuuugaauuccauaaacc
ucuacucuaaaguauacacuuaauucacaauacagacaacaaauaugcuuuuuccuaugaaagagugauaaagauacugu
aucagucugcuuugacucaaaaaaaaaaaaaaaaaaaaaaaaaaaaaaaaaaaa

TABLE 3-continued

RNA transcripts up-regulated during HF stem cell activation.

SEQ
ID
No: Access. # Sequence

173 AF093853  Sequence below.
uggaaugggugcuaggugaaggcuuuguugaaucaggaugcugagcuggugguuuuuacagguccagauaugaugagcugg
aguuuugguaggcccagguaccucuccaaaauugaccacauaauuggucacaaaucaggccuccacagauacaaaaauauu
gaaauuaucccaugcauccugucugaucaccacagacuaaggcugaucuucaauaacaacauaaaaaaugaaagccagguuca
cugcugcggcugcgccuccuuguucucagcgucaccacugccgccaugcccggaggguugcuucucggggacgaagcccca
acuuugaggccaauaccaccaucggccgcauccgcuuccacgauuuccugggagauucaugggggcauucucuuuucccaccc
acgggacuuuaccccagugugcaccacagaacuuggcagagcugcaaagcuggcgccagaguucgccaagaggaauguuaag
uugauugcucuuucaauagacagugugaggaucaucuugccuggagcaaggacaucaaugcuuacaauggugaaacaccca
cggaaaaguugccauuucccaucauugaugauaagggcagggaccuugccauccuuuugggcauguuggauccagucgaga
aggacgauaacaacaugccugugacggccgugugggugucauuuuugggccugacaagaaacugaagcugucuauccucu
accougccaccacgagcaggaacuuugaugagauucucagaguggùugacucucuccagcugacaggcacaaagccgguugc
caccccaguugacuggaagaagggagagagcgugaugguaguccccacccucuccgaagaggaagccaaacaauguuucccu
aaaggagucuucaccaaagagcucccgucuggcaaaaaauaccuccguuauacaccccagccuuaagucuuugcggaaauug
gggcugcaucugcacguccagcacuggggccugaggacgucagccggcagcegugggucccuugcagcaggucccguagaaaga
ucguggcaugaucacagccggucucuguagaucgcucgcuauacuacugggucauuaaauggaaauggcaccaaaaccuucuc
gggauucuuuacucugugccuucgccagcauucugcccucugccugucacagugcccuacugacuggcucucuuugaaac
gaauuauguauugaagauuccuuaggucucugcagggucuuugaucagcaagcaagguagugucagugugggcucugugc
uagaaugaugaaacaccuuuugugaaacggaacggaaucuucuguuacccauuuugggagagcacugacaugggggagaag
cuuucaauucuguauuuuuaguaaauaaaguggggacagccgggagaauucuuacagggaaucuauuguaaguuucuaucg
aagugggcucagaaaagccuuucgccucccaagagugcgcauguaccuccuagaguuccacaucugcucucuggugaugc
ugccugugaacgcaccuuauaaaagacgggcgggugacagugguuuuaccacucagugucccuaguaguggggugggccauuucug
aauucugcuuuuugaggucaacaaauaaaauccugaucagaaaaaaaaaaaaauagaaaagccaacaaucaugucggaaacuga
acaacacuacucaaugauuccuuggucagagaugaauaaagaaguaaaaagaaauuaaagacuuuuuagaguuuaauggaaaugaag
ccacaacauacccaaacuuauggacacaauguaggggcauuucuaagaggaaaacucauugcccugagugcauccaaaggaaaa
aaaaaaaaaccuagagagaguguacacuagcagccugacugcacacuuugaagcucugcaaaaaaggaaucaaauucaccca
agaggaauagacagcaggaaauaaucaaacuuagggcugaaacucaaaccaaauggaaacaaaaagaacuauucaaagaguggggc
caaaccaggagcuaguucuuugagaaaaucaacaagauagaaaaaccccuuuagccagcacucacuagagggcacagggacagcau
ccuaauuaacaaaaucagaacugaaaagggagacauaacaacagauccugaagaaauccaaaacaccaccagauccucuacaaa
aggcuauacucaacaaaacuggaaaaccuggaugaaaggaaaagcuucuagacaga 174 Z19521  Sequence below.
augagcaccgcggaucugaugcgucgcuggguucaucgcccugcuccuugcugcugccggagaagcucaguagaagacucaggc
agcaggaacgaguuccaguguagagacggaaaaaugcaucgcuagcaaguggguguguugcgauggcagccccgagugcccggaug
gcuccgaugagucccaaagacaugcaugucugucaccugucaguccaaucaauucagcugugggaggccgugucagccgaug
cauuccgacucucuggagaugugauggacaggaugacugugaaaaugaacaagcuguccccccaaagacgugc
ucccaggaugacuuccgaugccaggaugacaagugcaucuccccgcaguuugugugugauggagaccgagauugccuagau
ggcucugaugaggcccacugcccagccaccacuugugguccccccgcccacuuccgcugcaaaucauccauaugcaucccccagucu
uugggccugcgacggggaugucgacugaguugacggcuccccaugagaggccacagaacugccaggccgaagacacggccucc
aaaggcguuagcagccccugcuccuccuccuggaguucacuggguaguuucacuggaguucucacugcagcuggucuugac
ggcgaggcagacugcaaggacaagucagaugaggagcacugccgguggccaccugccgaccugaugaauuccagugugcag
auggcuccugcauucacgguagccgccagugugaccgugaacaugacugcaaggacaugagcgacgagucggcugcgucaa
ugugacacagugugauggccccaacaaguucaagugucacaguggggaguggcaucagcuuggacaagugugcgacuccgc
ccgcgacugccaggacugguccggaugagcccaucaaggagugcaacgagugugguugggggacaacaaaugugggcuguucc
cacaucucgcaaggaccucaagauuggcucugagugccugugucccagcggcuuccguuuggguggaccuccacagugugaa
gauauugacgagugucaggagccagacacccugcagcagcucuguguaaccuggaaggcagcuacaagugugagugccagg
ccggcuuccacauggacccacacaccaggggucugcaaggcuguggggcuccauaggcuauccugucucuucaccaaccgccacga
gguccggaaagaugaccccuggaccgcagcgaguacaccagucugcuccccaacucgaagaauggugggcucucgaacgggag
gugaccaacaauagaaucuacuggccugaccugucccaaaaaaaagaucuacagcgcccugaaggaccaggccccuaacuugc
cuacgacaccaucaucagugaggaccugcaugcccugacggggcuggcgguagacuggauccaccgcaacaucuacuggaca
gauucaguccccaggcagcguaucuguggcugacaccaaggccguaaagaggaggacacguuccaagaggcagggucccagac
ccagagccaucguaguggacccugugcauggcuucauguacuggacagauuggggaacacccgccaagaucaagaaggggg
uuugaaugguguggacaucacucacugguugaccgaaaacaaccaguggccaaauggcaacaacauagaucuuuccagugggc
cgucucuauugggguugauccaaacuccacucuaucuccagcaucgaugucaaugggggcaaucggaaaaccauuuuggag
gaugagaaccggcuggccaccccuucuccuuggccaucuaugaggacaaagguauuggacagaugucauaaacgaagcca
uuuucagugccaaucgacucacggguucagaugugaauuugguggcugaaaaaccucuugccccggaggacauugccugu
uccacaaggucacacagccuagagggguugaacuggugugagacaacgcccucuccccaaugguuggcuguccaguaccugug
ccugcccgcccacagaucggucccacucgcccaaauucaccugccgcccuggauggcaugcugcuggccaaggacaugc
ggagcugccucacagaagucgacacuguacugaccaccccagggggacaucgccgucccggccugugguccaccgcaucagcuac
caggccaccgaagcacaguggaucucucagcucccaguacuccuaggcagccugugacaccccagggcucagcacagugg
cgucagugacaguguccaccaagucccagggugacaugcauggugaagaggagcagccacaugguauggauggguucc
gucauccgucuucucccuauugcacugguugcccuccuuugccuuggggccguccugugugggaggaacuggcggcugaagaa
caucacaaaucaacagcauaaacuuugacaacccaguccuaccagaagaccacagaggacgagccucacauuugccgaagccagg
auggcuauaccuaccccucaagacagauggucagccuggaggacgaugugcaugagcagccgggagagccgucucuuuccg
ggauccauuccuggcuuaggcagaaaagacaccucuccagaccucccccauccagcacugguccugccaccuccoggggucu
guguugcucaaagcaagauagacaaagcugggcuggggggccaagcucagcuuccgucugcccaggguucuguuuuaua
uauuuaugucugggacagaaaaggcuacuggcugugcuugaaauucga 175 U04354  Sequence below.
accgucaucgggcucuucuuggggcucaggcacggaucaaguccucggcucgcucggccagcaccgcggcaccauggcgc
aggagcugcagcaccccgaguucgcgcgcaggccagcaggcugggcugcagguguggagggucgagaagcuggaacugg
uaccggugcccagggugccuauggugacuuuuacgucgagagcccuaccgguguccugcacaccaccaaguccagcagggg
cuucuccuaccgccugcauuucuggcugggaaaggagaguuucccaggaugagagcacagcggcugccaucuuuacguucca
gaugacgacuauuuggguggcaagccagucagagcagagagcuucaaggcuaugaucgacugauuuugugggcuauuu

TABLE 3-continued

RNA transcripts up-regulated during HF stem cell activation.

| SEQ ID No: | Access. # | Sequence |
|---|---|---| caaaggcggucugaaguacaaggcuggaggugugcuucuggacuaaaccaugccucaccaaugaucugacugcgaaaaga
cuucugcacgugaagggucggagagugucagagccacugaaguuccccucagcugggagagcuucaacaagggcgacugcu
ucaucauugaccuuggcaccgaaauuuaccagugguguggguuccuccugcaacaaauaugagcgucugaaagcaagccaggu
ggccauuggcauccgggacaaugagaggaaaggaagaucucaacucauuguggcuggaagaaggaagugaaccaucagagcuc
augaaggcuuuuaggagaaagccugagcuccagauggggacaaugaugacgaugucguagcagacauaaguaacaggaaga
uggcgaagcucuacaugguuucagaugcaagugggccaugaaaaguaacacgguggcugaagaaaaccguucuccaugg
gaauguugcuuucugaagaaaugcuucauuuuggaccaugguugcugcaaaacaaauuuuugauggaaagguaaaaaugcua
acccacaggagaggaagacugccaugaagacagcugaggaguuuuuacagaaaaugaaguauucuacuaauacucaaauuca
gguucuccggaaggcggugaaacaccaauuuucaaacaguucuuaaggacuggaaggauaaagaccagaugaugcuuu
ugggaagggugacauugcgagaaauggcucagaauaaagcagauuccguuugaugccucaaacugcacaguucuccgcag
auggcagcccagcacaacauggugggacgauggcuguggcgggguggagaacuggcguguaggaacaguggugagaguccag
auugacccaagcuccuauggcgaguucuauggcggugcacugcuacauauauccucuacacuuauccagaggacagaucaucu
acacauggcaaggagcaaaugcuaccagagaugaacugaccaugucccgcguuucugacuguccaguggaccggucccuugg
aggcaggcugugcaggccgugucucaaggcaaagagcccgcucaccugcugaguuuguucaaagcaaaccacucauu
auuuauagaaauugggacauccaagaaagaagggcaggccacaggcgcucccaccucagacgccuuuuuccaagccggaggaaccugg
caucuauccccaagaauuggaggaaguugacguugaugcaaauucauuuaaaauucuaaugacacauuugucauuaaaacugccacg
aaacaauggcuucaucucuggauaggaaaaggucagccaggagagaagaagaagcagaguauguggcugaugucucaag
ucaaagcuucaagaauucaagaaggcaaggaaccaggaggaauucuggaacucucuggagggaggaggagacuaccagacuu
caccauugucuagaaacucgggcugaagaccauccaccucggcuuuauggucuccaacaaaacuggaagaaucauauuga
agaaguuccggagaguucaccccaggaugaccuggcagaaugaugugcaugcuacuugaugcuggggaacagaucuuuau
uuggauugcaaagaugccaaugaaguugagaaaaggaaucagugaagucugcaaaaaugucacgaagcaaagaacagauccccuucu
ggaagagacaagaggacaccgaugugcaucaucaagcaagggcacgagcccccacauucagcuggtuuucuggcgggg
acuccagcaggugguaaaaaccagcaacuauccuggcugcauugggcagcugcacuuuguuggggaauuguuuacuu
uuuguuauugcuuugaagauaaacuccgccaaaaggaauaauaucuauauucuauauaucuauauaucuauauauucuauaucuau
aucuauacuauaucuauaucuauaucuauaucuauaucuauaucuauaucuauaucuauaucuauaucuauaucuauaucuau
cuacuauaugcuccucuuuccuucucuuuucaaaggaaaugcuguauguucuauaacugaaauaaccuaaagcaaccauu
uguuucgagcaauuuugcaaucugggggaccucugaggaaguaauuuugucauucagccacugcuagccaaacuugucuuu
ucccauagaggaaggagagccacagucguucuaagcauuuccccgucugcuacucuguuucguagagcuuuuacuuuau
guaugcuuuaacaaugccuugcuguuuccccaucucaagucaaugccacuuggaugccauucacuccccaagugccuuacau
aggaugaacuucuuuuagcuuuuuuagaaaacuaaaaucaugucuuuuuuaugauaaaacacauuuuauuucuauaaguuuaac
uuuauauauuugauagcacaugcucaauagcauaaagaauaugcauugaaugauguuuucauaauuaaaauauauccuuu
ugg 176 M35244 Sequence below.
cagggggugagagcaagaaggugcaggauguaggccagcagaauuaucagacccaguggcggcuucgccacuggaagaauuu
ccaacauaaaacagaugaucaguuugggacaaucgauucugcgaccagaggauguuacaucuggguuacuuuuaaaauucaga
uugucugggguuuuccaaucacucgcgacguaauuugaaguugguaucugagauaaaucaaucgcugucgucuaguuua
uaagcuguccaagaucugcccagucccagaugccggguccucagggcggcugguugcugcgccccuucuccugcagcug
gaugccagaccauccuggacucggaucccuuugggguucacacucgcuuagguauuucuacaccgcuguguccccgccuggc
cuugggggagcccugguuccaaauucgcggcuauguggacgacaugcagguccugcgcuucagcagcaaggaggagacuccg
aggauggcaccccuggccuggagcaggaggaaggcagaugacguggaacaggcagacucauauaguccacaauucaaggacagcugu
cugaaaggaaucuggaugacccugguucauuuuuacaacaagagcaugggacgacucucacacacuacaguggcugcaggacug
cgaugugggagccagaucggcaccguggucucuugguacaaccagcucgccuauguauagcgaggaaucuccccacccugagcgaa
aacccaaguccuguacaguggggaaacagcacuguaccucagaucucucagcaccuggagggccacugcucagaugugcugc
agaaauaccuggaaaagggagaggaggcugcugcguucagaccccaaaggcacauggacccgucaccccagaccugaa
gugaugucaccccugaggugcuggggcccuggguuucuacccugcugacauucacccugaccuggcagaaggauggggaggag
cugacccaagaugugagauuugugaggaccaggccugcaggggauggaaccuucagaagugggcagcuguggugcgugccu
cuugggaaggugcagagauuacacgugccaugaggacaugagggcugccugagccccuacccugaugggagccugcau
gguaccaaaagccuugguauuugauuguugccacggguuuuuuccauuuugcucauuugucucugugugccugcugagaccca
ugaagagaacaggugggagggagcggaaggcugacaccccaagaagcagcagacaguccccaagacucuuagcaagacugu
uguggaugaugaggauggggguuugcuuuuggaagauuaagccuguaaaacuugucuaggcacuccccaggaacuuc
aggaucaucuggggagaugcccuuugauggcugggcugugaggacagcaggccaguucuugccacccuggacagaaacaca
ucucaccuuucggcucgaggaucugaacaccugucucuugccuacucggcuuucuagucaggcauuuugucaccuugucaa
gggucccagggacacaagcucccuccucucacccacagcacucggguccuaccccaaugcuucagggacauuuaaucagg
ucaaauugggaucaauggcuuugaugcagaaaagaacuguggacuaauagagauagggguuuaauaaaaaaaaauaucuuuuu 177 AW121930
uuuuuuuuuuuuuuuuucaacuuuaaagacuggauuugagguucagucugggucucuggg
ggggaccucugucaucacgccuauaaucaucccgagaguaguucaucccuggagcuccacg
accgaucaucccgucugucauagcggucuucauagcgguccccaccuccucuguagucau
caucucuccgguacccacuuccaaaugcccuucugccacugccuauccuggagucauagc
cucggcauagcucugcucgcuguggagcccggccccccauagcggucca
ugucucugcguggccgucccgauauccgucccuauaccauccccgauaccggucugaau
cguaacgaucucgauacuugucuccaaagcuaucaucgccucuuucagguggguagucau
cacaacugucguggugggacgggccccuccagucugugucuguuuug 178 AI852632
uuuuuuuuuuuuuuuugcccccaggcucugucucaaggaugggaauagaucaagccaa
acagugaaaaauaaggcgaaaucguggcuucggggguuugagacuggcaccaauggcaaauc
agcagaggagaugcaaaugggguaacaaucacaguuagguggguaacaugagcaggcagg
aaacccuugagacaacacccaaggucacgucuucgcaugugcagggcacaacuccagca
gcaguuucggggcuuggaggcuuguuacucuuccuaccuuucccaccccuaaaagacac
caagauggagcccacgaagagauuacaucaagcucuucggcuggg TABLE 3-continued RNA transcripts up-regulated during HF stem cell activation.

SEQ
ID
No: Access. # Sequence

179 U70475 Sequence below.
ucuaggacagccagggcuacacagagaaacccugucucaacuaaaacaaagcaaaccccccgaauauuguuuuuauuugcg
gaugucuguuuauugagacggggguucauggcagacaugagugucucagugcauuugcuauccucucuuucaaaggggcgg
gggggggggugcgcuggagagguggcucagcaguuaagagcacugacuucucuuccagagguccugaguucaauccccagc
aaccacauggugcuuauaaccaucuauagugagaucugaugccuucuucuugccuguaggcagaccacuguauacauaaua
aauaaaucuuaaaaggggggggaaggugguggagcuaaaaguauggcaauaaugcauaaguuuagcuauuucuguuguuugc
agucaucagugagccaaacuaaucgaauggguagcuagaucuuguugcuuuuagcgaauauauauugagugaauggaauu
gacagucuucuguauucucauucaguuuguuuguguucuucccaucagugauaacauguagugaacuaacccguguggac
caucuuaaccauggcuucuccuuccuuuucuguuuuaaacauaggacauggauuugauugacauccuuuggaggcaagaca
uagaucuuggaguaagucgagaaguguuugacuuuagucagcagaaggacauaugagcuggaaaaacagaaaaaacucga
aaaggaaagacaagagcaacuccagaaggaacaggagaaggccuuuuucgcucaguuucaacuggaugaagaaacaggagaa
uuccuccccaauucagccggcccagcauauccagacagacaccaguggauccgccagcuacucccaggucacacucgucguggug
ggagcuaaggaaaacucuagugagaaagcagacucucuggaguugaguucuuggucugccauuuacuguguvcuuuugugag
gaggagaaguucucaaacuucgcuucuugauaaucaggacacagacacacagggaggucauagguvauauauaguucagaaacauccucu
guggugaugaaacagcggcagaaauacuguugggaguaaaagaaguaggcauugcucauuguggguaggcagggcccugauu
guaugggaacugacuuaacugguguvaaguaugauucccauuuuauauucccaugucuaaacaacuaaagcauuugcccag
aacacucagaaagaaaugaagggaggguauugccuagcacagagcccugguucaguccccacgcuguucguuaaaggggag
ggacuaaaauuugaacacaaucugguuugaaucuaugcaaaucgauuucugaauggagaccauagguuauuuuaugaaca
agucuuauugcucguuguvgacccuvgcuuagaacauuucauaaaugaugcucucugugccuuucccuuccuccaggung
cccacauucccaaacaagaugccuuguvacuuuugaagacuvguaugcagcuvuuuggcagagacauccccauuuguagaugacca
ugagguauaaaaaauguvuguvuvuaacagcaaaacucccvuuaucugaauauuaguccuuucaugugucuccaauvaagagaag
aaagaaauuuugaaggaaaaaauuvgaucaaagaaaaauugcaaguaaacuguaugaugagcuaauauaaugcuuaaaaauaa
gaccuguaugggcugguvgagaugguvcaguugguvaagaguvacccgacvugcucuuccgaagguvccagaguvcaaaucccagc
aaccacaagguvggcucacaacauccauaacaagaucugacucccvcuucvggagvugvucugaagacagcuvacaguguacuvuac
auauaauaaauaaaaucuuuaaaaaaaaaaaauaaggccuguaaacuacaaguccauuuacuguauagcuggaaacagg
aaucagaauaauuuccvcggaaacuggauaagaauauaauaaaauuugacuaguaaaagaacaacuauuvaaucagcauvu
ggauuaaaaaucuvuguguvuvugaagcauvucvugcuagauauvuauvugggvacagaauvaagvccuaauvgaaugvuvuuuva
uccauuvugaagucvugccvuvuaaauacauggaguvgaaauaaccvaggaguguauuaauvauggagucacugggaggaggaaa
uguuvucauuvuauvaaaagcagccvugagagcuguvaggcccugcugcugucuguuvcuucaugccvugvgcvucucacvucauga
aucaaugucacgucaaucuuvggcuuvucuvucacvuvgcauvuvucagucvgcuvugcccuvggavauvccccagccacgcugaaaguuvca
gucuvucacvugcccccaucaggcccagvuccvucaauaggcuggaggcagccacgugauvuuaaagcagcauvagagcagg
acauggagcaaguuvuggcaggagcuauvuvuccauvucccgaauvuvacaggvaagagagcucuvaggagugvugcuguuvuucugcg
ggcccuuvuaaauvuvagvucaucvuvaguauvuvauvauvuvuvacaugcvuvaccvuccucaaaggaagaaauvugauggvuvguvauvuvuaaa
uuvacvucaugagagcuvucccagacucacuvuvaacacacauvaguvuvuvuvaggvaaucagacvugaauvauvuvucuggauvaaauvucauvuvc
aaagacugaaagcuvaaaauvugagvucugacaaagavaaaaaacuvauvugaaaaagcccauvuvcacvaaaaagaca
agaacaccuvuggauuvuvggggvvagggaauvugavucaaaaaugcacuvuvagccvucugcvucauvacaaugugvaccvucvuvuccvuag
uguvcuuaauvaccgaaaacaagcagcuvggcvugauvacuvaccgcuvgvucccagcccagaagccacacvugacagaaavuggacagcaa
uuvaccauvuvuvacvucaucgavucuvcucgcvuggaaaaagaaguvgggcaacuvguvggvuvccacavuvuvuccvucauvggvuvuuvugagga
uvucuuvucagcagcauvccvucvuccacvugaugaugccagccagcvugaccvuccvuvagcucaaaauvcccaccuvuaaacacagauvuvuvu
ggcgaugaauvuvuaauvucvugcvuvucaugcagagccvcaguvgacgggcagcvugcvaugccvucuvuccvucvucvcgccaucagvucagvuca
cvucvucgaacvuccvuggacgggacvuavugaaggcvuguvgaccvuvgvucavcuvgvugvaaagcvuuvucvvaaccccgaagcacgvcugaaggca
caavuggaavucaavugacvucvugacvucvuggcvauvuvucacvugaacacaagvucccagcvcgagcvguvcccaccvagagcvcacvccgvuggagvuc
vuvuccavuvuvacggagacccaccgccvugggvvcavgvcacvucgvggaaauggaggavgcuaggvaugvgvccccvuggaaguguvcvcaaacvag
aacggccccvaaagcvcacgcvcagcvcacavvuvuccvuggagacvacagvvacavgcvcvucvguvcaccagcvucaaggvgcacagvugvcccvuavu
gcgvugaavuvccvcaavugvugvaaaaacaacaaaaaaagaaguvcccguvgaguvccgvugagcccccavuvuccvacvaaaaavgava
aacavuvuvucaavgccgcvuvuvagaggcvucavucvucacacgagavgavgvcvuuvgggcvaaaagcvuvccvccavauvuccavuvcccvugvucgaaaaa
aaucauuvvaaccvucccvugvuuvgavugacvucavuvgavaavugavugvuvuccvaaggagvaavcavugavagcvucagcvucgcavuvugavuccgva
gauvaucvgcaggvagagvgvaagaavuaaaguvcgccgcccagaacvugvaggaaaaggvaagcvuggagaaccauvgvugagcvuggagvc
agacvuvgggccacvuvaaaagacgagagavgaaaaacvuvaccvuvagavgaaaagvgvgagaaaacvgacagaaaccvuccauvcvuagaaa
agvgcggcvucagcaccvuugvaucvgagvucvacvaugvuvaccgavgavgaggavgvguvgaggaavggavvgavucvuvccvccagvgaavuac
vucvucvugcagcaaaaccaagagavggcaaavgvugvuccvuvuguvucccaaaagcaagaagccagavacaaaagaaaacvuaggvcggg
aggavggagccvuvuvucvugagcvuagvugvuvuguvvugvacvugcvuaaaavcvuccvacvugvaugvugaaavgcagaaacavvuva
vaagvaavuavgcagaavuavagccaaagcvugvavuavgcaavaavaavgaaacvuvuacaaagcavuvaaagvucvcaavugvuaa
vucagvuvcavuvuvuaacvcvucaaguvaavucvuvaggcaccavuvvgggagagvuvucvguvuvaagvgvvaaavacvuacagaacv
vauvuuvauacvuaavucvcacvuvgvucacvuagavgacvuavavgavcacvggaaaagcavauvuavaaavcvuauvaaaaccagacc
acvuavcuuvvuvuavuacvgvuvavgaacvaggaaavgacavuvaavaauvuvuvagcucauvaaaavuvaaagagagc
vagcacvuvauvaaagaavaucavgacuvuvaaacvacvuvuvgacvuvvugvaavuuvavucacacvuauvuvccauvaggacaavcac
ucavuvuvaccacavuvuggvuauvuvuvacavuvucaaaagggvuvugaaaavvcagaggcavuvvuuvauvagccaugvuggcagvc
caugauvuvuvuvauvcccgacavucaggaggcagaagcaggcagauvccccuggggccvcvaggacggcvcaaggcvuvacavgagagcc
ugcvucvcvaagaaagvacaaacccvuuvucvaauvacvuvaaavcgvuvagcvuaggauvuvugvucaaggavgavguvauvavuvccvucaaavggvuvaaugc
cugcvuguvacagvuvacvuvgvggcacagagaacaaaaccvugvaaccvuccvugvuguvucvuvagaaguvggcavuvucaagaagggcvuvagga
aga 180 U09659 ggccagcaggacucuccuugcagcagcggcccgaguucagaguccggagcugcggugvgug
gcggcgaaggcgagagucauggcuggacaagcvuuuvaggaaguuvcuuvccgcucuuvugac
agaguauuvgguugaaaggagugccgccgaaacuguaaccaaaggvugvgcauvuaugcuucca
gaaaagucucaaggaaaagugvuugcaagcaacggucguvggcvuguvggggvcaggagggaaa
ggaaagaguggagagauugaaccvugvcagugvugaaagvuggagauvaaaguvcuvucvuccca
gaauauggaggcaccaaaguvaguvucvagaugacaaggavuauvuvccvuauvuvagagauvagv
gacavuvcvuggaaaguvaugvcgacvugaaaucacvuguvgaaauggvugvcacgugaagcvugc
cavuccacvugavugvucvugaacvavuvucaucavguaaavuaavuvu TABLE 3-continued RNA transcripts up-regulated during HF stem cell activation.

SEQ
ID
No: Access. # Sequence

181 AW124785  uuuuuuuuuuuuuuuucaggucucauuuucguuuauuugaaauucggugcucguguaag
uuuuuucucuuccccucaaauuuuauuucaguaaaaggagacuuggcgagguggauacc
ccacagccggauucuuccccccugcccccagguggcuaaugcuaucuggggaagucg
ucauagggaagagaacuauggguggguccugccugaggccuccaaucucagcccagugg
acauaucacaggcagcuuaaaaaaaaaacccuaaaaaaaaacaccccaaaacacacauuua
aauagguauucaagacagcuuuaaaaaaugcacccacucacacccccucccuuuucuuu
uuggaaaaaaaauaggaaaaaaaaaaaaccaaaccgaauucucgcuuggccucua 182 AF071315  Sequence below.
auuuggcuccgaggccaagaauucggauccaaggcgggcgcggggaaaauggcggcggcagcugcggcggggcgaauggg
agcggaggcagcagcggcauggaaguggaugcagcagucccagcgugauggccuccggagugacugggagguguuuccguc
gcucuucauccccuugucauccuuaacaucucagaccauuggauccgcaugcgcucccaggagggcggccuaugcagguga
uuggggcucugaucgggaagcaggaggggcgaaauaucgaagugaugaacuccuuugagcugcugucccacaccguggaag
agaagauuaucauugacaaagaauauuuauuacaccaaggaggagacaguuuaaacagguuuucaaggagcuggaguuucugg
guugguauaccacaggggggccaccugacccucagacauccacgucauaagcaggugugugagauaaauugagaguccgcu
cuuucugaaguugaacccuaugaccaagcacacagaucuuccugucagcguuuuugagucugucaucgauauaaucaaugga
gaggccacaaugcuguuugcugagcucacuuacacucuggccacugaggaagcugaacggaucggugguagaccacguggccc
ggaugacagcaacaggcaguggggagaauccacugugggcugaacaccugauagcucagcauagugccaucaagaugcuga
cagccgugugaagcucauuuuagaauaugucaaggcgcucugaagcaggagagguucccuucaaccaugagauccugcggag
gccuaugcccuaugucacugucucccaguucucagcacugacaaguucaagacagacuuuuaugaucaaugcaaugacgugg
ggcucauggccuacucggcaccaucaccaaaacgugcaacacaaugaaccaguuugugaacaaguucaacguccucuacgac
cgacaaggcauuggccggcgaaugcggggacuguuuuucugaugaugguucuggaagggauggugugugggggcucagaca
gcuguuccauggaccugaguaccacauuccuuuagagaaacucauuaauaaaagagcagccccuaaaaaaaaaaaaaaaaaa
aaaaaaaaaaaaaaaa 183 D49733  Sequence below.
aaaacccaauguuugguuuaaaagccaaaauauaagggaagugcauagguuugggguuuuguuuuuguuuuuucccgag
guccuugaucuuugccccaaauuugagggcauaaaguaaucccucaguuaccuaaaaacacagccauuccuuugccauucc
acucuccuggauuggccgcuucugugcgcgggggagaggugacucacuauuacuacugaggaaagggggagccagugguga
agugggggugagucacugauggcagcagcuucagccucccccaacuuccuuggcucucuggggaugccugauccucuccc
ucacuuugcaccuacuuccccuggccucaccacuuaccuuugcccaccaucacaaauuucuuuuggcucugcucuuuuacucc
agaaggccaaaggcaaguuagaguugaguaggcaggaaccaacauuguguaagcccucaggccagaaaggggugggguucugaga
gugaggguuggcaugcuggcucuccucaccauaccugccccgccccuuugggucacaggaugggcucccuuuaagagcagug
gauccacccccuguagaggaggggccuauuagagcucucugccuggcugucagugacucaguguucgcgggaacgcugccuca
gccucaacaccagccaacccagaucccgaggugcgccagcgcccagcgaucuccgccaggagcgagcuuccggcgccg
gcucgcugucccccugagcagccucguccuucugucccaagucccgcgcccuucucgggaccccugcccagcgggcagcacu
gucaccugccggccauggagaccccgucacagcggcgcgccacccgcaguggggcgcaggccagcucuaccccacugucgcc
cacucggaucacccggcugcaggagaaggaggaccugcaggagcucaaugaccgccuggccguguacaucgaucgcgugcgu
ucccuggagaccgagaacgcgggggcugcgccuucgcaucacugaguccuuccggccccgcacccugaucagccccgcaguggucccggcgcauca
aggcggccuacgaggccgagcuggggauggcccgcaagacccuugauucugugggccaaggagcgcgcccgccuccagcuaga
gcugagcaaagugcgugaggaguucaaggagcugaaggcucggugagugaggcccggccggccggcaccagggaggcagca
gucgccuguaacuggccaucuagucccucccuccccggaacugccucccgcgggugacuggcagugccaannnnnnnnnnn
nnnnnnnnnnnnnnnnnnnnnnnnnnnnnnnnnnnnnnnnnnnnnnnnnnnnnnnnnnnnn
nnnnnnnnnnnnnggcuaggccagauauagaaagcuuucuguauuuaauacacaguacaugcaucauucaugucuacauaa
uuaagauaaaggaagcugcauuguuaaugggaaaaaaaauagggucugggaauguagugugccuagcauuuacgaacuucg
ggguuugggguuugauccagcaucucacaaaccacguguaauccagcacuuggaagguagaggccggaggauccgaaguu
uaaggucauucuugacuacuuagcaaauucggggcacccuaggauaccuagagaccgucaugaauaaaaaauaaauuuaaa
uaaaccaauauggucuagguugagcagcagcuugggcagguuagggcccggaaguuagccagguagaggguugcaguccca
ggaggacccuggcugggagcagcaccucagucccccugcccaaccacagggggccaccggucuuuccggaacucugagggc
gcaaggccuugcucucucuggcccagccauggggaacgcggagggccggugaggcaggcggcaggcgggcgggcggggcgc
gggccgucaucccccuccugcuccuuauuuuuagcccagugagagucugggccgccugucccuccccaggacagggggag
gaaauunnnnnnnnnnnnnnnnnnnnnnnnnnnnngaugcaacaauccuaaugaaugaugcccucuucugacagcugcgggac
cgcagagaggucccaucccagaugcacuccugaaaccugcuuuucuuuucuagcaacaccaagaaggagggggacuugug
gcugcgcaggcccgcucaaggaccucgaggcucuucucaacuccaaggaagcugcccugagcacugcucucagugagaagc
gcacauuggagggcgagccucaugaccugccggggcagguagccaagguugagacccugagccccagugaccccacc
uggccgacauaucauucggcccauuugccugcucaccuucacuuuccagucuagannnnnnnnnnnnnnnnnnnnn
nnnnnnnnnnnnnnnnnnnnnnnnnnnnnnnnnnnnnnnnnnnnnnnnnnnnnnnnnnnnnnnnnnn
nnucuagauggggacagccaucaccucuccuuuggcauuuccugaaccccucccaccucuccaugaacuugcuuucuccc
ucucagcuugaggcggccugggagaggcuaagaagcagcuugaggaugaugagagcugaggcgaguggaugcugagacagg
cuacagacgcugaaggaggagcuugacuuccagaagaacauuuacagcgagguaagcguccgcuguacagguucuuuuac
uguggacagcugggaggggucaccuaauaugccaggcuaagcgagggcugcccgugccuggccgguggaguuacgacuuc
uggucucagcuucuaaggaaccauugcgauguucuaaucuagugucucccuuaaccuuucaggaacugcgugagaccaag
cgccggcaugagacgcgcuuguggagaucgauaaccggagcagguguuuggagccggcgugcagaugcccugcag
gagcugcgggcucacaugaggaccagguggaacaguauaagaaggagcuagaaaagacauuccccgccaaggugcuggccu
caucacugucccucucccuggugcugccuggggacgggguggugguggcagggggccagggaugccuuccucaggccccag
cuccagguuccugcucuauaacugugugcucccugcagcuggauaaugccaggcagucugcugagaggaacagcaaccug
uggggcugccuaaggaacugcagcaguccucgaaaccgcauugacaccgcucucggcccagcucagccagucagccuccaaaagca
gguaaccucaguuuacucccccaccuuggcucuggucuaagcagauacugcacugaagaaggggugggggag
ggacuccaggaccacaugcuaugguucugaaucaugacugcucuggcuuucaggggcucccuuuagcuagcccugaucc
ucagagccucuauuuuacugugcaugaagggguuuucauguuucuucugccugccggagacugaaccagaggccucuug
cuugguagauagguuguuuucucacugauuacaaacccagccgcauucccuacuggagauagagcuucccuuggacugga
cauguagcucaguuggauacagugccuugcuuauuauacacgauggccuggcuucuaucccaggaccnnnnnnnnnnnnnn

TABLE 3-continued

RNA transcripts up-regulated during HF stem cell activation.

| SEQ ID No: | Access. # | Sequence |
|---|---|---| nnnnnnnnnnnnnnnnnnnnnnnnnnnnnnnnnnnnnnnnnnnnnnnnnnnnnnnnnnnnnnnnnnnn
nnnnnnnnnnnucuagagagagccuacagauccugagugucccucugccugcccugugcccuccccucuucaucgacauca
gcccuugggagcucaucagaccuuugucuucccgccccaguuggcagccaaggaggcaaagcugcgugaccuggaggacu
cgcuggcccgugagcgcgauaccagccggcgccugcuggcugagaaagagcgagagaugggcggagaugcgggcgaggaugca
gcagcagcuggacgaguaccaggagcugcuggacaucaagcuggcccuggacauggagauccaugccuaucgaaagcugcug
gagggcgaggaggagaggugaacuaggaggggucuacagaacuugucaggggccucuggccgcaacuaccaugacuaacccc
gcaccgugucuccaccuucccagggcugcgccugucccccagcccuaccucgcagcgcagccguggccgcgccuccuccacu
cauccagcucucaggguggaggcagcgucaccaaaaagcgcaagcuggagucuuccgagagccggagcagcuucucgcagca
ugcucgcacuagcgggcguguggcgguagaggaagucgaugaagagggaaaguucgugcggcugcgcaacaaguccaacga
gguggcugugaaccaggguggucuuuucaguggcugggagaacuuggaauucucgauggagcaucugucucccuaucugag
aauuuggagugugugguaguccugucaucuuuaaauugugggaagaugcaugauauaagggaugggugacccuugagcca
auagucuagguuugaugccagagguagugguggaagccugucuucuuuucuuuucuuuucuuuucuuuu
ucucuuucuucucucuuuuuuuuuuuccgaugggggucuugcccagguuggcuuugaucuccuaguuaagcuguucccc
ugccucagccuccauaguagcuggaacugcaggngcacacuggcgnccagccuaccuaagcuccugagugagauaauccaag
agucgguugaacuccugccucccuucccuucccuucccucccaccuacuucaggaccagaccuagggcaacuggcaga
ucaggcgucagaauggugacgauccuuugaugaccuaucgcuucccaccgaaguuacccuaaaggcugggcaggugguugga
gguggugugaagggcacugggagacucuggcuggaguggagaaguuggccucaggacaggagcauuaaaaauaagcacaucu
cuuaaaccaucuuuucccagaucuggggcuucaggagcuggggccacccauagccccccuacugacuuggugugugaaggcgca
gaacaccugggcuguggggagcagccuucgcaccgcucucaucaaccuccacuggagaagugaguauguugcagccggauagcu
ugccuggacaaggcuccccccgggugaccauaauggaacuagcuaccuccaaccccaaggaaaccugccuuggguuuaggucg
cuuuccugagcccaaguccaccagguaagcaagccagaagucuccccaguagaauaagggguggaagucagccagugagug
uuaauagcagacuccagcuuacagagcaccagagcucucaguugugucuuuuugcgcgugcgugcgcgcgugugcacaugu
gcaugugguuauccuuagucccagcaucagaagguugcacaagguuguauaaagggcccggacaguucuaaaggguuacua
uggguagacaggcugcacagcccucaccccgacucuuugggccuggggcuauugucccccacaggaaguggccaugcgcaagc
uggugcgcucacugaccaugguugaggacaaugaggaugacgacggaugggagaagagcucuccaucaccaccgugugag
uggcagccgccgcugaggcccagcccacaagggguagccugccagccuagggcagcucuccccaccuccaugccaaagucuuu
ucauuaaagaaauguuuuggaaugccacugcugcccuggccuuucuucucucucuccucccucuaccuugaacagggaacccag
gugucugguaaggaagggaguggggacuugcugaugccaauggauacuccacggugcagugggacagggguucuggauuugu
guccugggaagggcugggaggacagaggugcccccagcccuggccucucuuuccucacuccccauugcaugcacacuucucucc
ucucuccuuccaccccuauugcaugcuucccucagauuucccugcaacaaguuucucuuuccuuccuugucccccucacaaauu
aagucucuccaucuuugcucuuccucuugauugcccauaagugucuaagauucaggagagaguuaaagccacagcucuuu
auuucgaaggcuucuggcuauuucccccaucaugcccuuccucccagccacaggucucccaaguccccaucacuuggugu
cuggguacagacagaggucaccuuccugcccaaggccaggaagcuccaagagcccacagccuaggugccgguccuaagaag
ucaguccccaaacucgcugucccucccugagccuugucuccccuucccagggguuccacugcagcggcucgggggaccccgcuga
guacaaccugcgcucacgcaccgugcugugcgggacguguggcugcugacaaggcugccgguggagcgggagcca
gguggggcgguccaucuccucuggcucuuccgccuccagugucacagucacucgaagcuuccgcaguggugggggcagugg
gggugcagcuucggggacaaccuagucaccgcuccuaccuccugggcaacuccagucccggagccaggugaucaucuc
ugcccuacagcaggacacugcucacugagcagcagggcagggcagcccaagggaguggggucccccuccuugcagucccucu
ugcauccugcccuccugucugaacccagacucgaggucagggcaaggcccagagugugagggguuggggagacaacccuu
uggggucaggaggagaggaaagggccagccugcacugcugcucacacucucuuucucucucucuuagagcuccagaacug
cagcaucauguaaucuggaccugccaggcagggcuggggcagaggccaccugcuccccccucaccacaugccaccuccug
ucugcuccuuaggagagcaggccugaagcaaagaaaaauuuauccccugccuuuggguuuuuuuuucuucuauuuuuuu
uucuuuuucuaagagaaguuauuuucuacaguggguuuauacugaaggaaaaacucaagcaaaaaaaaaaaucuuuaucuca
auccuaaguccuuccccuuucuuuccuuguacugccuuaaaaccaaagggcuucucuaggagcccagggaaaggacugcuu
uuuauagagucuagauuuuugccugcuuuggcuuuaccucaccaggacccugugacaaugugccugagaggca
ggcauggaguucucuuccagccucuuccuccaacagcuggcccacugccacgccagcugcagagaaaugggcgcagagagga
ugacugagaaggucaagcccccucccggcacuacacgaggccgaggccucucugccugccuuaccuucuuccugcccuuccc
uagccuggggcgaguggauucccagaggcaaaucugccgugcuugcuuuuucuauauuuuauuuagacaagagaugggaau
gacggggaaggagaagggaagaucaguuugagccuaccuuuucccagcuucugagccugguggucucugucucaaugaugg
agggcaauguaaguggguauacaggaagagugggggacgaaggccucagagugggaaccugcuggggcugguagag
aagucuagaggugcggcgauugguggcuacagcaaaacuaaggaacccuucaccccauucccaucugccaccucugcucuc
ccuccaaaucaauacacuaguuguuuccaucccagaugcugugugucuuugugggugugaugugugguuucaggg
gcagacacaugcacacagaggugccacacauucacuauauauucacuacccagcuauaaaggugguauagggagacuucu
agaaaggucagcauaugugggugagcgaggggugccuuccuaucccucauccauccagcaccuuuaaaaggggccagca
auccacaugugcaucagacacaggagcacagagacggagggguagaguagggcagaguagcagagcuuccuugcugcccug
uagucgcaggcucuugaucgugugaucgcu 184 X80899 Sequence below.
gcggugcgaagcgggccuccgccaacaugacuacaaguuuagcaguuucacgcagaaguuggcuggagcuugggcuucgg
aagccuacacccgcaggggguuaaagccaguuucacagaagcaccacuuaucauauuugccacccaaccaaacugaccuc
agugugacagcauaugauuauucugggaagaacaaaguuccagagcugcugaaguuuuccagaaggcugauggguuuccac
cugaaacgaggccuuccagaccaaaugcuuuaccggaccaccauggcucugacacugggagggaccaucuacugccugaucg
cccucuacauggccucgcagcccagaaacaaaugagccuugccugugaggacugguucacuuugugggcacaaacccuuugaa
uccucacguuucauguuuccacuuggauagucuacuuaacauuuugcaaacaaaggaaaagauaagaauacauuguuuug
auuuguuuauggugugcagauggccugucagaugucagagcuggguugacaguuaaaacuauugguuuaaggaaaugucac
ugagccaucacugagcugucugccuucgcucugauuucgcuuggcagccuccgcuucucccgcucauucgugggcc
agccgugcucagggccucgggacucaggcggugucugagcgggaagcgaacgcgaagccuuuggagugauggggguuggaauu
gaggaaggaaaacaaaagccagccggacaggugugaagugagggcugaguuagccacccuagggauucgccgccuugcaga
aaacauugagaggaaugauagcaaccugcucuauuugugggcaguuggguuucaaagggguuguugucucgcccagaaccu
aggaaauggguguuuguuccaucguggggaggagcaccgucagugcugcacauuagacagcugugucaggacuucuccuu
uaauaaugcuguggcuuuacguuaugauugaccggacugcggaauaaacacuggaaucaaaaaaaaaaaaaaaaaaaa TABLE 3-continued RNA transcripts up-regulated during HF stem cell activation.

SEQ
ID
No: Access. # Sequence

185 D83203  Sequence below.
cugagacagaacgaaacguccgcagauaacuacccguucuggcucuuguuaguucuaugguguauggauaaugucuuggag
guuuugaaaugccacaagccuugcuggcccaggggugcagcugccucugccguucagaccucagauuauaaggacagaacaca
gcacggaaguggggggaucagaaccaugggagauccaggacgaagggucugugcgcaggugcggcaccgaauccuauauu
ugacauugaagcugucgucagcccaacuagugguguuauuaacauggaagcacaaugacucaggcgcuucagaauguagaaua
gagaauaagauggagagcaaucugacguuuccuguuaaaaaccagacaucauguaacauuacaggcuuaagcccagguacuu
cguauacauucuccaucaucucuguaacaaccaauagagaccuugaacaaaacuaucacaacagagcccggccagugucugau
cuccaugucaccucugugggugugaacacaggcucgucucaccuggagcaaugcaaauggcacugccuccuaccggaugcuga
uugaagaguugaccacacauuccuccagucaauauuucaggucugaagccgggagaccaauaauacguucgcuuucccagaauc
aaaugagacacaggcugacuuugcagaggagguccccggaucgccaagagaaucccagugaccaaccua
ucccaaccacacaagaauucuugccucucuguggacccaccucuuggccaggaucucccucacagagaucuugcuuacuga
ccuaaagccugaucucaguacaaugccaccaucuauucuaagcagcaaauggcacugaaggacagcccaggaacaaagugu
uuaaaacaaauuccacccaggguucugacguccgagcuaugaacaucagugccucaagcaugacccugaccuggaaaagcaau
uacgaugggguccguacucaauugucuacaaaaauacacguggcuggggggaccacuccgucaaccaaacuguccaauaaga
cugaggccaucauccuccggacucagcuccagcaccuugucaacauggcaccaggguucauccuuuccugggucagacggagggcac
accaggcuuccuccaagguauacacuuccccgaucagguuucucugacuuccgagugacaaaugucagcacaaagggcaauuggu
uuuggcuuggaggagcaaaugacuccaaguccuucgagauuuucaucaagcaggacgagagguugagaagcaucgaaaaugcuucg
acgggaaaaccagagcuauauggguuugaagauuuaaagccuggaaccaguuaccauuuugagauaauuccacgaggaccagacg
ggacagaagggcuguccaguacaguguaauggggagcaccugacccccagugccgugacugacaucccggggugucaacauuagcac
cacugaaaugcaguuggaguggcagaaauacggacgaugcgcucuggauacacuuaccauuuaguucuagagucuuaaaagugcc
uccaucaucaggaccaacaguucagaagguuggaucacaguagggagccucaccccaggcaccuuauacaaugucacaaucuu
uccagaaagugggccagauccaggggaaucuccaacuccauuaccgggaccagcgcccagcggacugguguuccacaugaaguaa
acaccaccaccaccaccggcagccauccgauggaagaacgaggacacagccucugcuuccuaugccuaucccguccuuaucuug
aagacuggagaugggcagcaauguaaccagcaacuucacaaaaagacccuucuauucuaauccucugaguuaauccuggcgucu
cuuacacaguugagaauccuuacaaauaaguugggaguggggaugacacaaucaucugguaccuggguuggaagcuguucuguacggaacc
ugaaucaaguugaccuccuuccacugugaagugguccccuaaggagccagcauugguguucucaagugggccugccccuuugggcau
guacacaggccuuucgagucugggggcacaggaugugauuccugggacaaauauagacacgcccuagagaacuugcacaucggaugac
acagagugcaggacggaagucgccuauuugaauuuuuuucuaccucguacaacaucagcaucgccaccuugcaugugggaaga
uggcgcuucccgcccagaacaucugccaccacuggcaucacagaccccaccuacuccggauggauccccuaauauuacaucgguc
agucacaauucaguaaagguuaagcuucagcggguuugaagccagcccacggaccuaucaaagccuaugcugucauccucacca
ccggggaagcugcccaaccuucugcagauguuuugaagguacagcguauggagguuucaaaaggggagcucggauacuuaug
ucacauaccucauaagaauagaagagaagggaacagcucucaggguucugucugaagcuugaacuauugaaauugauggggaa
ccaauccacuaccccuccggcuacuacaacgggagcuggagccucuccgggcuccuaccgggauugaguuggcuuuaccaau
auuaccuacaaccuucagaaugacggccucaucaaauggggaaugagagcuaugugucuuuucagcuccauauuucagaggccgug
uucuuugcccaggauccagggucacagguugucauucuggggcaguguugggauucauccgcccuggccaucacagcuggggga
ggcuucaucuucuggagaaagaaaaggacaggaaaugccaaagaauaaugaagugucccuuuucucaaauuuaaaaaccuaaaaauccca
aguuaauccgagugguugagaauuuuugaggccuacuuuaagaaacagcaagcugacucuaacugugggguuugcagaggaauaug
aggaccugaagcugauugggauaaaguuuaccuaaauacacagcugagauagccgagaacaggggggaagaaaccgcuacaacaa
uguucgcccuaugaauuaucucgaguuucaaacuuucaguccagacccaucaucgacagucaagucaaucaucaaugccaacuauaug
ccuggcuaccauuucaagaaagauuucauugccacacaaggaccuuuacccaacacuuuaaagauuucuggcguauggguu
gggagaaaaaacguauaugccaauguuaauguugaccaaaugcguggagcagggaaggaccaaaugugaggaguacuggccuuu
ccaagcaggcucaggacuacggggacauaacugugggcgaugacaucagaagucguucuuccagaauggaccaucagagauuu
ugugggaaaaauugcagaaaugcagagaagccauccucugccgcaguuccauuuccaucgccugcaagucacggguguccccu
gacaccacugaccuggcucaucaacuuucggaccuggcccgggauuaucaugaagcagauaccccccgagucaccaauuccug
ugcauugcagugcuggggggcuguggaaggacgggcacuuucaucgccaucgaucgccugaucuaucagaaugagaaugagaaca
ccgguggacguguauggggauugucuauugaccuucggaugcacaggccucugaugggugcagacagaggaccaguauguuuucc
ucaacagugugguuuggauaaauucagagcccagaaagacucaaaagguugucauccaugaccaacggcacuuuguc
aaucuaugaaaaccucgagccaaguucccuugaaugugacuauguugcuucauccacgucugaacgauuuugauguguggggu
ucuaggucguggcuguugcuggucugcuaggaucaggggccuuguugacaucggaagauguaaaauugucccgcugaagg
ccgcaguuuagauguggccacuagauggagccagagcacugguauugaagagcaccagggccguguaaaggcaaaagaggac
ccagaaaagaaacuuaacuuguucacuccugagaaaccugcaagucaacaagccaaggaaagugccuuugcaugcauuugu
agccuuuccaauccccguuauuacauauaugauucaugauuccauggcaaaaaaaaaaaaaaauaaaaauaaaauaaaaaaaagg
aaaacaaaauaaaaaaaaaucuuuagaacauu 186 Z20410  gcccccucaagggcauccugggcuacacugagcaccaggguggucucccucugacuucaaca
            gcgacacccacuccuccaccugacgcugggggcuggcauugccucaacgaccaccuuuguc
            aagcucauuuccugguaugacaacgaauuugcuacagcaacagggugugggaccucaugg
            cccacauggccucccaaggguaagccccuggaccaccagccccagcaaggcacaagaggaagg
            agagacccu 187 AI839906  uuuuuuuuuuuuuuucauauuaaacuuguaguuuuauucagguuugauuuuaaca
            aaugugucaggagagagcccacaggaaagggauaaagcccgugggggcaaggccuucccca
            gaugccugaggagggaucguguccccuccccccuccucuuucuccaccacccuacaggggg
            uuugggaagagacacaggcagggaaggggucugguccccagucuguacaguggugcuugg
            gggugaaggacuauggagaacaggggaccagaucgggggaugaguaggauaaagggcaca
            agaccauuuaccagaauccagcuuucugauuccaaauugaauuaaaaagaaaaaaaggag
            aggggaaccuaaaccacaagcaguacccaacuccccuuucccccaucagggcugc 188 AI843448  uuuuuuuuuuuuuuuuagggaagaggcugaugccagauaaguuuuuauuauauuaaa
            aaaaaaaaaaaaaccagugcaacuggaaaucaggggagucgcuggaggugagugagagu
            cggaaggcccuccacaccucagugguggcaggaucuggacccguagccuaagccuggcu
            gauccagccgagaugcuggaaagcagagcacacggugggugcccaucagggcaaagagggc
            aagagagcccacggcuccuccauaccgcuugcuagggucuccugguaguagccauaugc TABLE 3-continued RNA transcripts up-regulated during HF stem cell activation.

SEQ
ID
No:Access. # Sequence guaaaggacucgcccaauaauccaggccaggcccaggccagaagcuaugcgcgggguggua
aacaccucccaccguuaggaaaaa 189 AW125336 cggccgcgugaguuugacugagcuucugcangaaguucanaugcaauccauacauca
guucauuuucuagcauuaccacuggguuauuaucacgaauggccgauuuaauaagaguccu
uuugcauccucggaauuccaggggcugaccacuuuuaaaccugggcagugcccauacca
ugcagcaaagcauugcgagugcugagcagcuacaccugcugaggcgccauuggggccccu
gaauacuaugggcaca 190 AW123802 uuuuuuuuuuuuuuuugaagggccauuggaguuuauuuacagacaaccuuaggugag
gccuuuccucuaggaucuacaugcuuuugaaguuacuugguuucaggcuucuugucu
ccagcuucgagcuugagacucucaggaggcuggcgauaggcagggaaagccucccaggg
gcuguucaggucaaacuugcggaauucuugcagcuccacugguucagccacuaccc
gcuuuaccucaucgucguaacgaagcucaacauagccagugaggggaaagucuuuccgga
aaggaugucccucgaagccauaaucugucaggauccuucuuaaaucagggugguuaaaa
aaaaaaaaaaaaaaaaaa 191 AI835771 uuuuuuuuuuuuuuuuggggggcagcgaacuuuauugaugguauucaaaaaaauagg
gagggcucccuaggccccccccuguuauuauggggggucgggaugggaaauuuugagggaa
augcucaauuuuggggggcccauuugggaaaaggcccccuugcccaaugucccuugcugg
gguggugguccaagguuucuuacuccuuggaggccauuuggccaagagguccaccac
ccuguugcuguagccguauucauugucaaaccaagaaaugagcuugacaaauuugucau
ugaaaaaaaugccaaccccggaaucaaagg 192 X53584 Sequence below.
gcuccucaucucacucgggccuaugccaaagaugaaaauuggugcggaugcucgagccuuaaugcuucaaggguguagac
cuuuuagccgaugcuguagcuguuacaauggggcaaaggggaagaacagugauuauugaacagaguugggggaagucccaaa
guaacaaaagauggggucacuguugcaagucaauugauuuaaggaguaaauacaaaaauaucggagcuaagcuuguucagg
auguugccaauaacacaaaugaagaggcuggggauggcaccaccacugccacuguucuggcacggucuauugccaaggaggg
cuuugagaagaucagcaaaggggcuaauccagugaaauccggagagguguugauguuggcuguggaugcuguaauugcuga
acuuaagaaacagucuaaaccugugacaaccccgaagaaauugcucaggguugcuacaauuucugcaaacggagacaaagaca
uugggaacaucauuucugaugcaaugaagaagguuggaagaagggucaucacagugaaggauggaaaaaacccugaauga
ugagcuagaaauuauugaaggcaugaaguuugauagaggauauauuucccccauauuuuauuaacacaucaaaaggucaaaaa
ugugaauuccaagaugccuauguuugguugagugaaaagaaauuuucagguucagccauugucccugcucuugaaauu
gcuaaugcucaucgaaagccauuggucauaaucgccgaagaauguugacggagaagcucuaagcacgcugguuuugaacaggc
uaaaaguugcucuucaugguugaagcaacaagcuccaggguugggucaacaggaagaaccagcuuaaaagauauugcua
ucgcuacuggugugcggguguuugagaagagggguuugaaucuaaaucuugaagaugaaguucaagcucaugauuuagggaaaa
guuggagaggucaucgucaccaaagaugaugccaugcuuugaaaggaaaagggucacaaagcucacauugaaaaacguauuc
aagaaaucacugagcagcuagacaucacaacuagugaauaugaaaaagaaaagcugaacgagcgacuugcuaaacuuucagau
ggaguagcuguguuggaauguggaagaaagauggcaucauguaaagaagaaacagaguuacugaugcucucaau
gcuacaagagcagcuguugaagaaggcauuguucuaggaggggggcugcgcucugcuucgguugcaucccagccuuggauuca
uuaaagccugcuaaugaagaccagaaaauagguauagaaauuauuaaaagagcacuuaaaaauuccugcaaugacgauugcua
agaaugcaggugguugaaggaucuuugauaguugagaaaauuucugcagaguuccucagaaguugguuaugacgccaugcuug
gagauuuugugaacauggugaaaaaagggaucauugaaccaacaaagggugagaagaagcccuuacugaagaucuguaugggg
uggccuccuugcuaacuacagccgaagcuguagugacagaaaauuccuaaagaagaagaaggacccuggaaugggguggcaaugggg
uggcaugggaggggguauggaggcggcauguucuaaacuccuagaguagugcuuugcccuuaucaaugaacugugacagga
agcucaaggcagguccucaccaauaacuucagagaagucaccuggagaaaaugacugaagagaaggcuggcugaccacugu
aaucaucaguuacugguuucuuugacgauauaauaaauggguuuacugcugucugucaugccuuacagaauauuauuuug
uauuuuugaauaaagaacauuuugcauuccugaugcugguugcaagagccauauaccagguccugcuuucaacuuaaau
cacugaggcaucucuacucuucugugagucaucaggacguagcgcugugucaacaaaacauagagaguucagaagacagcc
uuucugugaaggguggaaugauugugucacaaaguagagaaguauccaauuaugugacaaccuuuguguaa 193 M32599
acagccgcaucuucuugugcagugccagccucgucccguagacaaaauggugaaggucgugugaacggauuuugccguau
uggggcgccuggucaccaggggcugccauuugcagguggcaaagguggagauuguugccaucaacgaccccuucauugaccucaac
uacaugguucuacauguuccaguaugacuccacucacggcaaauucaacggcacagucaaggccgagaauggggaagcuuguca
ucaacgggaagccaucaccaucuuccaggagcgagaccccaacaacaucaaaugggugugagccggugcugauaugucgu
ggagucuacuggggucuucaccaccauggagaaggccggggcccacuugaaggguggagccaaacgggucaucaucuccgcc
ccuucgccgaugcccccauguuugugauggguguggaaccacgagaaaauaugacaacucacucaagauugucagcaaugcau
ccugcaccaccaacugcuuagccccccuggccaaggucauccaugacaacuuuggcauuguggaagggcucaugaccacagu
ccaugccaucacugccaccccagaagacugugggaugggccccucguuaacaagcugugugggcgauggccugccccagaa
aucaucccugcauccacugguggcugcaaggcuguggggcaagggucaucccagagcugaacgggaagcucacgccauggccu
uccguguuccuaccccaaugugguccgucguggaaucugacgugccgccuggagaaaccgccaaguaugaugacaucaagaa
gguggugaagcaggcaucgagggccccacugaagggcaucuugggguuacacuggagaccagguugucuccugcgacuucaa
cagcaacucccacucuccaccuucgaugccuggguggccugauugaccaacaacuuugccuggguaucauuuccugguau
gacaaugaauacgcuacagcaacagggugguggaccccucauggccuacaugccuccaaggaguaagaaacccuggaccaccc
accccagcaaggacacugagcaagagaggcccuaucccaacucgcccccaacacugagcaucccucacaauuccauccca
gacccccauaauaacaggaggggccuaggggagccucccuacucucuugaauaccaucaauaaaguucgcuugcacccac 194 AF035644 agaagcuuccuaaggaacaagcaaguugaauagagaaaauagugaucaauaauaggcauu
uuaguggucuuuuaauguuuucugcugcggaacauuucaagauuuauugauuccucc
ucccccauuuuuucccaccacacucacacacgcacgcucacacuuuuauuugccauaa
ugaaccguccagcccugguggagaucucuuaugagaacaugcguuuucugauaacucaca
accccaccaaugcgacucucaacaaguucacagaggaacuuaagaaguacggagugacaa

TABLE 3-continued

RNA transcripts up-regulated during HF stem cell activation.

| SEQ ID No: | Access. # | Sequence |
|---|---|---| cuuugguucgaguuugugaugcuacauaugauaaagcuccaguugaaaaagaaggaaucc
acguucuagauuggccguuugaugauggagcuccaccccuaaucagauaguagaugauu
ggcuaaaccuguuaaaaaccaaauuucgugaagagccaggcuguuguguugcagugcauu
guguugcaggauugggaagggcuccugugcuaguugcgcuugcauugauugaaugcggaa
ugaaguaugaagaugcuguucaauuuauaagacaaaaaagaagaggagcauucaauucca
aacagcugcuuuacuuggagaaguaccgaccuaagaugcgguuacgcuucagagauacca
augggcacugcuguguucaguagaaguagaagcaggcuggcuggaucguggcauuagagg
gaa 195 Y00629    Sequence below.
auucagguucucacagaccoagggggugaggaugauugcuuuuugcccacuugcuucagcugcuggucagcgccacaguec
cgacccagaguaguaagugagggaggggugagggaggggagggaggggauugggagcgaaaaagacucugugaggaaaagcgggagggu
gguggcggaggugcagcaccccaaguuccgccgcccuguccuaguccucccccgccuuuaccugggaccuugagccug
ggggaggucggggucucaccgcgcgccgccccaggcccacacucgcugcgguauuuccaccgccgugucccggcccggc
cucggggagcccggguucaucauugucggcuacguggacacgcaguucgugccucagacagcgacgcggaaaauccga
ggauggagccucgggcgcgguggauugagcaggaggggccggaguauugggagcgggagacuuggaaagcagggacaugg
ggaggaacuucagaguaaaccugaggacccugcucggcuacuacaaucagaguaacgacggugagugcggcuggaucacag
cuaugaucacuccauguccccugagacgggccugggucaucuugacccgcugagacaaaguuucauccaaacgccuaccag
aaccucagacaaaaaagcccccgcagaguucgcuuaggguuugggguuguacuuuuguuuucuuuuuguuuugagauauc u
acuaacauugggcaaagugggccacagguggcgcucacagcguauccuuccagaaucucacacgcugcagugaugu acgg
cugcgacgugggcccgaugggcgccugucccgcggguauugucaggaggccuacgauggccaggauuacaucucccugaa
cgaggaccugcguccuggaccgcgaaugacauagccucacagaucucuaagcacaagucagaggcagucgaugaggcccac
caacagagggcauaccugcaagguccuugcgguggaguggccucuagaauacaccggcuggaaaugagacacugcagcgcu
caggugccucggagagcucuccucacuuuuccucugcgguuuggggaaauccuugagguauaaccucaggggcagaacgc
uguucagcgggcacagcgcggaggaggaggagagggacuccccaaaacugcuuuuccccuguagggauucuaauccuuaaca
aaagcagaucaggcucgacaauggcccuggacccaugggggggagggggcucuuucucaggccucccuccuugcccuacucag
ugucucuauagucagacuccagcuuuucuaaucucuuggcccucauccagcucaggaccagaagcccuuccucaugagucug
cagagaccuggagccuccucuguccaauggucugcucacaucucaaaggcauccuaaggagcagauccucccagggcagguug
cucuagcugguguucuagaugauggacaccauaauccaccgcaguccuccugucaacccaggacggucacaugaacacugc
ugaguccccagaagaaagcaagaugcucaucccuuucaacucucuccccagacccuccaaaggcaugugacccaucaccc
uagaucugaagaugaagucaccugaggugcuggggcccugggcuuuaccocugcugacaucacccugaccuggcaguugaau
ggggaggagcugacccaggacauggagcuugguggagaccaggccgcugcaggggauggaaccuccucccaggugcagcugu c
guggugccucuugggaaggagcaguauuacacaugccaugugucaccaugaggggcugccugagccccucaccugaugg
gguaaggagggugugggugcugaacuggggucagggaaagcuggagccuucugcagacccugaguuggcuacaggcucagag
cugggaucauaacccucaccuucauuuccuguaccuguccuucccagagcccuccuccauccacugucuccaacaugguaauc
auagcuguucugguugccuuggagcugugaucaucuuggacgcugugggcuguuuugaugaagaggaggagacacau
agguaggaaagggcagggucugagguuucucucagcucuccuuuugcagugugcucugcuccuuaaugggaaacauagccac
acccacauugcugcagucccaacugggucagcugucaguuccgggaacuccuagggcugguguuucucuggucucucau
ggcuuuucuucacaggguguaaaaggaugcuaugcucauguucuagguaagugcgagagagggcaggggacacccuugu
cccugagcucucaggauggagcugggauuuguuccagccauaaucucucugccucucucucucugugu
gccuuguuaucucuuucuacgcaggcagcaagagcuuccagaccucugacuggcucagaaggcaugaaaauccuggggggg
gcugguguugagauggcucaguggguaagagcacugacugcucuucgaaggucccagagucaaauccccagcaaccacaugugug
gcucacaaccauccguaacgagaucugacuccccucuucuggagugucugaagacagcuacaaugucuacuuacauauaauaaa 196 AW125380    uuuuuuuuuuuguuccccuugaaagccagauguuccaaaaaguagccugcuccauuguucu
ucucagucucauagcgacugccagcgucaauccacacucccaccgugcagguagcaugcg
aggacugcuccgaggccacacgcagcccguuguccaagaugcugaccugggucuccggca
cgcucuggagggccugggcgaagguugcgguaccccgcaaggcagguaaccucagcaggg
ccggcgagcggcgggugcgccucgugccg 197 U68564    Sequence below.
ggugcuuaauguuuugaccuguagaggccucucacuuuucgucauggcgcugaagguggcgauagcugcuggcggugcugc
aaaggcaaugcucaagccaacucucccucugccguccuugggaggucugggccugcauuggccccccgaagcagcauuucc
ucacaacaaacaauuccuccaucugcuaaguaugugggcggcauacagugacuaugauccoaggcgaugcaucggccoag
agcucauguugcauguuaagucuguauucaggcaugcaugugugccgguggacuuugaagaggugcauguaagcuccaacg
cugaugaggaggacauccgcaaugccaucauggccauccgccggaaccguguggcccugaagggcaacauugaaacaaauca
uaaccugccaccauccacaaaucugaaacaacauccuucgcuagccuagaccucuaaugccaacgucaaccucacuguaaga
gccugccaggaguggugaccccgcacaaggacauagacaucucauuugucgggaaaacacagaaggcgaguacagcagccu
ggagcaugagaguguaggagguggugagagcuugaagauuaucaccaaagccaagucccugcgcauugcugaauaugc
uuucaagcuggcccaggagagugggcuaagaaagugacggcugugcacaaggccaacaucaugaaacgggugauggacuc
uuccuccagugcugcagggaaguagcagcccacuaccccucagaucaccucaaggcaugaauguagcaacacaacaauuga
gcugguauccaggccucagcaguuugaugcauggugaugccuaaucucuauggcuaacauugcaacaacgucugucagg
gcuaguggaggcccaggccuuguggcugggccaacuauggccauguauugcaguauucgagacagcuacaaggaacac
aggcaaaaguauugccaauaagaacauugcuaacccgacugccacacugcuagcaagcugcaugaugcuagaccaccucaagc
uccacucccaugccacuuccauccgcaaaagcugucuuugcacaugaaugaaauaaugcauaccccagauauauuggagg
ccaggcgccaacacaccccaagccauccaggacaucauucgucauauccgcaucauuaauggacggcguguggaggcuuagcua
ucccuacaguuuugcucagcuugcuguaggacucucuucucacuuuagcacuccagcuagcuugggggacaggaccoga
auaaagccacuucuguuccagaaaaaaa 198 AW125346    uuuuuuuuuuuuuuugucuuaauagaaaacuuuauuuucacugauaaugucacugua
acauaauuucauagcagaccugucaaaagaucccacaucaccaauguuccaagagauu
ucacacacuucuggcaggacgcacagcucugccccacccccguugacagucaacau
uuuaccccgcuaugaguacagaaaggcgaggcaucauaacgaagccgccugaaggcagc
gugagcugaagucggacgcuugccaccucugaaugaauggucaccacagcaacagcacau

TABLE 3-continued

RNA transcripts up-regulated during HF stem cell activation.

| SEQ ID No: | Access. # | Sequence |
|---|---|---|
| | | gguugccucagugugcucaggguggguduuugaaaaaacgucccacuauguaaauaugcu gcacuuaucccuucaacauugu |
| 199 | X61232 | See above (same Accession Number). |
| 200 | D20333 | gauccuguauaugugaguuugggggagcuaugauaaguuuuauggcaaacgguugguau uguuaacuuuuauugucaucaaaaguucauaaaaguccuauuaaucccauauucunnn ncugcccuuaacucugguauacaccaaaaagaaaucuuuacuuuccuuguuuuaucauua uaaaaauaaaguauuuugcuaguauggaaa |
| 201 | AB025218 | aguccgcgucccggcgucggcccgucccgcaccauggugacgcucgccgagcugcuggcg cugcuggccgcgcugcuggccacggccucgggcuacuuugucagcaucgacgcgcacgcc gaggagugcuucuucgagcgggucaccuccggcaccaagaugggccucaucuucgaggug gcggagggcggcuuccuggacaucgacguggagaucacaggaccagauaauaaaggaauc uauaaaggagaccgggaguccagcgggaaguacacauuugcagcccacauggaugggaca uacaaguucugcuuuagcaauaggauguccacuaugacuccaaagauaguaauguuccac auugacauggggaggcucccaaaggacaagacauggagacagaagcucaucagaacaag cuagaagaaaugauuaaugagcuggcaguggcaaugacagccguaaagcacgaacaggag uacauggaaguccgggagagaauacacagagccaucaaugacaacacaaacagcagagug guccuuuggucccuucuucgaagcucuuguucuaguugccaugacauugggacagaucuac uaccugaagagauuuuuugaaguccggagggguuguuuaaaaggccuuuuccuguugauc caaauucaugauuuacu |
| 202 | U84411 | Sequence below. | gcauuggcucugggcugcggccggcucggcgacgcuccucgggcagcucacugcauggucgucuggugccccgccgccug cauccccgccgccgccccgcgacgccaccgccgccugcccugccgccgccgccugccgccucgggaccggcuguaugauu aggccacaaucuucaaugaguagacauauuccucaguucuguggguguuucucggucacacauuuauggaguuucugaaggc aguggagauuacugccaggcacagcacgaccucuaugcagcaaguagcauauucauuacuacuccaccaagaaacc cccauaagaguggauaaccuggacacaggcguguugaauugaaaucugcacagcauuugagaagagcucagaccuggauggg guaaaccucagugccacuuccuuuguauugcccucuaguauuacugggauugaagagucacugcuucuuguuuaggagguuc auuucauugggcccguuucucccaauuucauacucaagcacugagaauuucaaguggaguauaucgaauaucgaaguagacu ucagguuguuuuugguuuuguuuuguuuuuuuuuuugguuguuuuguuuuggguuuuuaaaucau uucuguauucaauuuuuuaauucuuucauaacccuauuggguguuuuuuuaaacuaaauuaacauggcucgaaugaaccgc ccugcuccuguggaagucacauacaagaacaugcgauuucuuauuacacacaauccaaccaaugcgaccuuaaacaaauuuau agaggaacuuaagaaguauggaguuaccacaauaguaagaguaugugaagcaacuuacgacacuacucuuguggagaaagaa ggcauucauguucuugacuggccuuuugaugauggugcaccuccauccaaccagauugucgaugacuggccugauuugcaugcaua aagauuaaguuucgugaagaaccugguugcuguauugcuguccauugugucgcaggccuuggcagagucccggugcuugu ugcccuagcauuaauugaagguggaauggaaauaugaagaugcaguacaauucauaagacaaaagcggcguggagcuuuuaac agcaagcaacuuuuguaucuggagaaguaccguccgaaaaugcggcuccgcuucaaggauuccaauggucauagaaacaacu guuguauucaauaaaacuggggugccugaugccauugccuuugagguuggaacuucagauggaccuagagucaugcaua uuacccaaguguucggcuuacugaauaaguucuacugcagcuccacaggaauacugaaaaaccagucuuaccaggccacaagu uugacagaauugcaaccucuauauuugggcuaugaucaacauguuuggcacuuagcaaaagauuuuugcuguucagcauu uaaaaugugcuuauuauuugaccaauugaccuuuccuaaaaauaaggguauugaguuaugucauuaaaugauacuccugugcc agaauauauuauagucaauaaggaaunaaggauuaggugccaaaaaucccagcacaauacuuguauauuuuuaagcaucau acagaaccaaaauugcaggaacugagaacucucagaccauccauggugauauccuucagucauuucaaacacugcagggcuc cucucguuaucugccugcucacucuguuuacaucuccacacuuaugccagaauacgucaggu uugcuuagccauccuuua uuuuuuuuuauuuuuuuuuuaacuaaagucuugcgcugauuauuuaauauguccuguccauuuugguuuguuuugggaaa cccucgucugaaaaaucaacuuuguuucagaagcacauaucuucaacaaugucuccagacaaaaagccuuauaguuaauuua augauuugccacucagaagugcaaccuaacagggaggggccugaaaaagaaacgagaggaggcuauuaaauauuuuuagaaauau guugccuuugucaugucagaacauguagaguaugcucuaauuuaguaaauauuuuuaagacauagagauacauguguag cuaacccauucuuauuccaaaauucggaauuuugugguuuuccnauccuaucaggaaguuuccagcuuguuugaauuaugg cuuuccucuuccaaucucuugcaaaaaagacaaaguggggaugaaucugcuagugaacugagcagaaauguuuuauaacgcc uuuugagcuaguaguaacuuaauuauaaauuggaucuugaucauuuguuuuuauaaggaugguguaua aaguuaguucaaccauauauuuauacugucugggaaugugguauaguucugugggagaaauauguuugucagguguuca ccagcuuguaaaaacuuaguauagagcuucaacauuuaaauaaaugaugaaccgcauucgucacugaggacacuuuugccu aaaauuaacuuaauuuguagaaaacaauggaucaguuaauaucauuucaauuuauggaaaaaauuuguagggguugccaag ugcuuuuuauaaaaguuucucuuuaaagucuagaaauugaaaguuagguguggcccgaggggaaacaguuu guaauagaugaucuagauuuucaguucaguuccaucagucacuugagcucugcaauuuccagaccaguuuucucauuuu uaaguucauuacaugccuguauuuauauugaaauuaacuugaaccugaguauuggcacaugauggcuuaauaaauuuaa cuuuc

| 203 | M62362 | Sequence below. | acgcucccaaccuccaccuccccucgcucggccucuauaugcucccgggcucccuaguguuggcuggaaguggugacuua gaggcuuaaaggagggcgccuaaccacggaccacgugugugcggggcgacagcgccgccggggugggcugagcgcugc aagccgggucgccuugcagcgcaggagucaggguggcguugccgccacgaucucucucacuagcacuaugcucccgccccac ucaccgccuugaaagucacaggagaaggcgggcucuaagacccagcaggcaccauccuacuggcgccuucgauccgagaccc guuuggacaccaggggcgaugccgacccucuauaaaagcgguccccgcgcgggcuggccauucgagaccgaagcugcgc gggcgcgagccaguuggggcacugggugggcggcggcgacagcggcgccacgcgcaggcuggaggccgcgaggcucgcca ugccgggagagacucuaacucccccauggaugccgacuucuacgagguggagcgcggccccgaugagcagucaccucc agagcccccgcacgcgcccagcaacgccgccgccuuuggcuuucccgggcgcgggcccgcgccgccccagccccaccugc cgcccggagccgcuggccggaucugcgagcacgagacgucuauagacaucagcgccuacaucgacccgccgcuucaacga cgaguuccuggccgaccucuuccagcacacgccgacagcaggagaaggccaaggcggcggcgggccccgcggguggcggcggu gacuuugacuacccgggagcccgcgggcccgccggcgcgguccauguccgcggggcgcacgggccccucccccggcuacg gcugugcggcggccggcuaccuggacggcaggcuggagccccuguacgagcgcgucggggcgccgcgcuacggccgcugg

TABLE 3-continued

RNA transcripts up-regulated during HF stem cell activation.

| SEQ ID No: | Access. # | Sequence |
|---|---|---|
| | | ugaucaaacaagagccccgcgaggaggacgaggcgaagcagcuggcgcuggccggccucuuccccuaccagccaccgccgcca<br>ccgccaccgccgcacccgcacgcgucucccgcgcaccuggccgcccccacuugcaguuccagaucgcgcacugcggccagac<br>caccaugcaccuacagccuggccaccccacaccgccgcccacgcccgugcccagcccgcacgcugcgcccgccuugggugcug<br>cgggccugccuggccccgggagcgcgcucaagggcuuggccggugcgcaccccgaccuccgcacgggaggcggcggcggugg<br>cagcggugccggugcgggcaaagccaagaagucggugggacaagaacagcaacgaguaccgggugcgcgggaacgcaacaaca<br>ucgcggugcgcaagagccgagauaaagccaaacaacgcaacguggagacgcaacagaaggugcuggaguugaccagugacaa<br>ugaccgccugccgcaagcggggugggaacagcugagccgugaacuggacacgcugcggggcaucuuccgccagcugccugagagc<br>uccuugucaaggccauggcaacugcgcgugaggcgcgcggcugcgggaccgccuugggccggcccccuggcuggagacccca<br>gaggauggguuucgggucgcuggaucucuaggcugcccgggccgcgcaagccaggacuaggagauuccgggugggccugaaa<br>gccuggccugccuccgcgugucccccuccuuccucugagccggacucggugcgucuaagaugagggagucaggccguggugg<br>uuucuccuugagaccgagagacuuuuucggcagcugagcuggggcccggcaguacuaguauuaaggaaguaaccuugug<br>ccuuggauacucaaaacucgcuccuuuuccuaccgaguaggggggagcaaaaaugugccuugauauuuauuggaggauuc<br>cugcuuccucucgggccucagcuggccccgugagaaaaaugaagggugcaggccccagggcaggaggaagauacaggaagcu<br>gagauccccggcagugcccugagcugcccccucagucccugucuuuagaggggagggacuuagguguuggggauuugagucug<br>ugucccucaccccccagcuacagggaggugggagggcuccuaaaccgucuuuuugcaccuccaccuacaccucaucccccccccccac<br>ucagcuuacaacaggccagguuuccugggugaguucauggagaaugggggcaccaccccccagucagacagaaagcugaguug<br>ugaguuagccaugugguaggagacagagaccuagguuucgggcuuugugggugggggauaggaggacacgggggaccau<br>uagccuugugugucugacuaugucgccagccgcuguugcugaaggaacuugaagcacaaucgauccauccccagagggacug<br>aguuaugacaagcuucccaaauauuuugcuuuaucauccgauaucaacacuuggucucugugucccagcggugcc<br>uugugcaaggcagugugcacgucuaugucuaaaccaccauuuuauuuggucuuuuguuuuguuuuuugcucugauu<br>cuugccaaacugagacucuucacuaacggcuggggggaaggagcugagugaggcucucauucuuuuuggguuuagggauguu<br>ugggguuuuucgucugccucccagaggaccaaugaaaugaagugggcuucccccucucccuaguugccaagggguguaug<br>uaguagugggucuuagcuuccuccggcuaagacuuaggcuuccccaccccacccaacccccaacccaccccaagcgcccuggcucug<br>gucuggaagaaaggccaccuccagccaguucauacacacaccccugugggcugggagcagggcugggaccgcuuccuucucuuc<br>uuuuuuggggggggggacacaaaguuucaugcuagaugucguaugauauuuauaauauaaacauaucaaacucaa |
| 204 | AA032310 | gaagcucagugucgugaaauggaaaccaaaccuuggagccaucgcugaguauaaaaaaa<br>ggaagauuuauauuucngcaaagaguagccgaacuggacaaaauuacuucugaaagagaua<br>auuuuagacaagcauaugaagaucuucgaaaacaaaggcugaaugaauuuauggcugguu<br>uuuacguaauaacaaauaaacuaaaagaaaacuaccagaugcucacauugggaggagaug<br>cugaacuggagcuuguggacaguuuagauccuuuuucugaaggaaucauguucaguguuc<br>ggccaccuaagaaaaguuggaagaagaucuuuaaccucucaggaggcgagaaaacccuua<br>guuccuggccuuaguguuug |
| 205 | M94087 | Sequence below.<br>gccgguuugaguugugcgcucggguguccuuuccucuuccuccccucccgcagggcuugcggccaccauggcguauuagaggc<br>agcagugccugcggcagcguuggccuuugcagcggcggcagcagcaccaggcucugcagcggcaaccccccaccggccuaagc<br>cauggcgcucuucacgaaauccagcagcaguuugcuguaacggacaaagauaccuucgaguuaagcacauuccuggaaucc<br>agcaaagccccacaacaugaccgagaugagcuucugaacagcgaagcuguugcgggggacuugaugucccccuucgaccag<br>ucgggugggggcugaagaaagcucuaggucucuuagaucguacuggaggugccacaggggcacuugaaaccucauggguuc<br>uccagcgacaaggcggggcuccucggaauggccgcuaugdagguauggcuuggccagugccucagacaccggcaaggaggaug<br>ccuuuccgggacagauuggauguuggagaaauggaucugaaagaguuugacuucgaugcucuguuucgaauggaugacc<br>uggaaaccaugccagaugagcucuugaccacguuggaugacacaugugaucuuuuugccccucuaguccaagagacuaauaa<br>ggagccccucagacagugaaccaauuuggccaucuccagaaaguuuaauaaaagucgaccaggguugccccccuuuacauuc<br>uugcagccuuuccccuguuccccaggggguucugucuuccacuccagagcauuucuuuagcuuuagcagcaguaaguu<br>gauaucucugaaggagacaggaagccugacucugcugcuuacauuacucuaauccucccaugucuaaaggaggaagacacuc<br>ccucugacaaugacagugggcaucguauggagccccggagccuaccugggcucuccccagcauagcccuccaccuccagggc<br>cccaccagacaaucugccuucuccaggugguccccgugggggucuccucggccccaaaccuuuagacaccaccuggaguuauguug<br>acagcuaagugaagacugagaaauugggauaagaagcugaaaagaggggcaaaacaagacagccacuagguaccgcca<br>gaagaagcgggccugagcaggaggccucacuggcggcgaguguuaaggaggcuagaaaaaagaaaugaggcucugaaagagaagca<br>gauuucucuuggccaaggagauccaguaucugaaagaccugauagaagggccguaaggcaaggggggaagaagagaguuccgu<br>aauagggguagucaggugcuuugugcuuguacauagaucuuguguugcuguguuugcuguaauaaauuauuuuguagugaaa<br>gu |
| 206 | AI847609 | uuuuuuuuuuuuuuaguaggggaaguucauauuuuauuugccagugacauuuuuuac<br>aguugaauacaaguuaaaggccugcuugcacaccaaagccagguccuuugggugguucag<br>ucaaagaaguaaggccuccagcuggcucacaacagaagcgccucuccuuuggccccuugguuu<br>gggaacuuuuccagcuuuugaguucaucaauaaucucuucaauauccuuggggugucagauc<br>cucauaguaguugucauuuauuugaaccaucggugcauuuacacaggcccccuaaacauuc<br>cacuucuauaaagaugaaaaguuuguucagguguaugucucuccaaccuuuuauuccaa |
| 207 | AI853294 | uuuuuuuuuuuuuuugggggugaauauagccaaguauuccauuuuauuaaacaaaauagu<br>cuuagcaagggagagcucuguucaccccacaagaggccccgcagccgaggccggcccgaag<br>ccccagcgcugcugcguaagaccgggagggaggggaaggugguuggggagaagacuuguauu<br>aagucuuuaauccuagccaccgcaggaaccaccggaaaccuaaugccaguuuuggcgaau<br>gcuggcucaggucugggacauggcgaagggagugcucugauccuagggcuccccugagucc<br>ccagccugccccaacagagcucuaaaguugucuggucugcugacuugaggacugguaa<br>gcuuuggagggauccaucaaggauuccccgaccccaccccuaucgccagggga |
| 208 | M33934 | Sequence below.<br>ccucugcggcgcgguucucggagcggcgcgguucucggagccacgcgucugucuuccucgguguccauggcggacuaccug<br>auuagcggaggcaccucuuacgugccggacgacgggcucacagcgcagcagcucuucaacugcgggggacggccucaccuaca<br>augauuuucucauucuuccuggguauaucgacuucacugcagaucaggugggacuugacgucugcucuaacuaagaagauua<br>cacuaaagaccccauugguuuccucacccauggacacugucacagaggcuggaauggccaucgcgauggcgcuuacaggagg |

TABLE 3-continued

RNA transcripts up-regulated during HF stem cell activation.

| SEQ ID No: | Access. # | Sequence |
|---|---|---|
| | | uauugguuucauccaccacaacugcacaccugaauuccaggccaaugaaguucggaaagugaagaaauacgaacagggauuc<br>aucacugaccccguggaccuuagccccaaggaucguguacgcgauguuuugaggccaaagccaggcauggcuucuguggu<br>auccccaucacagauacaggccggauggggagucgauuggugggcaucaucuccucaagggacauugauuuccucaaggagg<br>aagagcaugaccgguucuuggaagagaucaugacuaagagggaagauuggguggucgccccugccggcgucacucugaaag<br>aggcaaaugagauucugcagcgaaguaaaaagggaaaguugcccauugugaaugaaaaugaugagcugguagccaucauugc<br>ccggacagaccuaaagaagaaucgugauuaccccccuggccuccaaagaugccaagaagcaacugcugugugggcagccauu<br>ggcacucaugaggaugacaaguauaggcuggacuuacuggcccuugcuggguggaugaguggguuuugggacucuucccag<br>ggaaacuccaucuuccaaaucaauaugaucaaauacaucaaggagaaguauccccagucuacaggucauuggaggcaauguag<br>ucacugcugcgcaagccaagaaccucauagaugcaggguguagaugcuuugcgagucggcaugggaagugguuccaucugca<br>ucacccaggaaguguuggccugugggcggccccaagccacagcaguguacaaggucucugaguaugcccgucgcuuuggug<br>uuccuguuauugcugauggaggaauccaaaaugugggucaauauugccaaagcuuuggcucuuuggggcuuccacagucauga<br>ugggcucccuccuggcugccaccacugagccccuggcgaguacuuccuucucagauggaucggcugaagaaauaccgagg<br>uauggguucucuugaugccauggacaaacaucucagcagccagaaccgauacuucagugaagcugacaaaaucaaagugcc<br>caaggaguuucaggggcagugcaggacaagggcucauccacaaguucguuccuuaccgauugcuggcauccagcauucc<br>ugucaagacauugguugccaagaguuuaacccaagucagagccaagacucggggagcuuaaaauuugagaaggacau<br>ccucugcucagguggaagguggcguccacagccuccauucgcuacgagaaacggcuuuucugaaaacagauccaguauaugcc<br>uugaauuuucauaaaaguuugggaaaaaaaagugaaaaaaaaaaaaaaaaaaaaaaaaaaaaaaaaaa |
| 209 | X16202 | guguggggugcagagcuggggucagggaaagcuggagccuuuugcagacccugagcugcuc<br>acggcugagagcugggcauuacccucaccuucauuccuguaccuguccuuccccagag<br>ccuccuccauccacugucuccaacauggcgaacguagcuguucgguuguccuuggagcu<br>uggccaucauugcagcuguggugcuuuugugaugaagagaaggagacacacagguagga<br>aagggcagagucugaguuuuu |
| 210 | AI661431 | acaggagggaaggccaaagcaagaaugaaaguccccgccccguaucaccacgggcacu<br>cggggucaccccucaggaacaugcagucucugcacgugaggaaagaaacacgcagagaugg<br>acgagcacuuuucacccuaauaaaauuagaugcacuaaccacagaccccccu |
| 211 | AI839109 | uuuuuuuuuuuuuuuuaaaaaaaaaaaugcaucuuuuauucaucaaucccuguuacac<br>acugaaauacaugcaucuuucuuauguuacuuagcaacguccuuucuauccuuucacccca<br>uaaaucagucgaugaauucaucuuuaaauucaagaaguuuucuuuuugaaacgcuacu<br>uacauuuuauugcucuaauucaaagccaaucuagagauuuaauucuuccuacaggugaaa<br>uagauguuaauacgggaacagucaguacauguucaagaugacaucaaaguuaugccccuaa<br>gcagauauuucaaggcaauaucaugccacuagcucugagacucuaaguaucacugauagu<br>acuaaaaggguagaagucagcuucaaaaacacacucuugcaauggacacugcucaugaugu<br>cuaagauuguucacucccacagucaugauuucagaugcacaguuuuuuugcuuuccuga<br>gcauucgguuugac |
| 212 | AI849135 | uuuuuuuuuuuuuuuuaagagugucaccaaagcuuuauuuacaugcgucaucaucucuu<br>uuacaaacuagauuauggguuuuaaauggaauacacaggcaauaucuacaaacgccacggg<br>aaguacgcaccuccauuccaccgggaaggggcagauuccccaaaucaaacuggguuuugauc<br>cuugagaagaaaggcggcagagcuaacucacggcagcguauggguuagacaaggucucag<br>uacccagaaugcagcaggauugcgucugccucaaaaccagacgaccaacugcugcaggugu<br>uuaaacaauggccacgcgccacacgaaauucuaguuugugugggguagaagcaagaaaaaa<br>aaaaaaaaccauggcgccucgugccg |
| 213 | M32459 | gguccggauaguaaacugcucccuuacaucuccuuaaauauaaaguaaggaaaagaaaa<br>aacucaguucgggguaaccaaguucaacaaguaauccuugggccgcuguguaucgccaa<br>aaucuacauaguaucucuauuaaaaaaguuuugacgaaaaaugauaacaauuacggguacuua<br>auggauacaauguggcugaggaagcaauaguuaacaaagaggagcuaagcuaugcaacaa<br>accagauuucuauuggucacaaauuugaaguagaccuguuauccaauuaccaaguacu<br>uccgcauacaucaucauaggcauuugaagauuucaaccaaucaggagcauguuccuucua<br>uaaaggaacccagaaccuaaccucugcauuuccuauuucuuuguagaaauggcucuacg<br>aagcagaccgcucgcaaguccacuggcggcaaggccccgcgcaagcagcuggccaccaag<br>gccgcccgcaagagcgccccggccaccggcggcgugaagaaaccucaccgcuaccguccc<br>ggcaccguggcgcugcgcgagauccggcgucaccagaagucgaccgagcugcugauccgc<br>aagcugccguccagcgccuggugcgcgagaucgcgcaggacuucaagaccgaccugcgc<br>uuccagagcucggccgucauggcucugcaggaggcgagcgaggccuaccuugugggucug<br>uuugaggacaccaaccugugcgccauccacgccaagcgugucaccaucaugcccaaggac<br>auccagcugggccccgcuauccgcggcgagcgggcuuaauaggcacgcuuucuacacugg<br>cacguaaaccaaaacggcucuuuuaagagccaccuccauuauccaccaaagaugcuugaa<br>guacaaguugugagaguuuucuagggguuuccuauuauagccuuucuugacaaugugagca<br>ccacccgacgaagcagucugag |
| 214 | AI841389 | uuuuuuuuuuuuuuuuuggacuucugcggcuuuuauuuuugcauguaaaccacuggggg<br>aggggaucuugaugguggcacccuagagauuacacuggaguuccgagggcuccagaca<br>cuagcugggaagucagugacagaaacaauggauucgagcacaucaugaaugcaaaacu<br>gggucccagcagggauucuggugguucaggugugguugaugccuaaggaagcagugacauggg<br>aggggcacgcacugggcuggccuugagcugcugggaugacaucagggauagaggaccuag<br>cagcugguggcuccagggaucuccggcucaugcuuuauuuggccaggggguuccugaagg<br>accugccagcaaacuuggcuuugcugcccagcucuuccucaauucugaggaucugauugu<br>acuu |

TABLE 3-continued

RNA transcripts up-regulated during HF stem cell activation.

SEQ
ID
No: Access. #  Sequence

215 X03039    Sequence below.
auucuaaggaucaugucugcgagucaggauucucgauccagagacaauggccccgacgggauggagccggaaggcgucaucg
agaguaacuggaacgagauuguggauagcuuugaugacaugaauucucucagaguccuccuccguggauuuaugccuaug
guuuugagaagcccucugccauccagcagcgagcuauucuuccuuguaucaagggguuaugaugugauugcucaagcccagu
cuggacugggaaaacagcuacauuugccauaucaauucugcagcagauugaauuagaucuaaaggccacucaggcuuuggu
ucuggcacccacacgugaauuggcucagcagauacaaaaggguuuauggcauuaggagacuacaugggugcucuuguca
ugccugcauuggggggcaccaaugugcgugcugaggugcagaagcugcagaugggaagcuccccauaucaucgugggguaccccc
uggccgggcuguuugacaugcuuaaccggagauaccugucccccaaauacaucaagauguucguacuggaugaagcagaugaa
auguuaagccgagggguucaaggaucagaucuaugacauaccagaagcucaacagcaacacacaggaguuuuguuguuguug
cuacaaugccuucugaugccuuggaggugaccaagaaauuuaugagagaccucauucggauucuugucaagaaggaagaau
ugacccuggagggcuauccgccaauucuacaucaauguggaacgagaggaguggaagcuugacacacauugugugacuuguaug
agacgcugaccaucaccaggcagucaucuuuaucaacaccagaaggaagguggacuggcucaccgagaagaugcaugcccga
gauuucacuguuucugccaugcacggagauauggaccaaaaggaacgagaugugaucaugagggaguuccggucuggcucu
agcagaguauuaauuaccacugaccuguuggccagaggcaauugaugugcagcaggcucccuuagucaucaacaacuaugaccuuc
ccaccaacagggaaaacuacauccacagaaucggucgaggugguucgguuuggucguaagggugugcuauuaacaugguga
ccgaagaagacaagaggacucuucgagacauugagacuuucuacaacacccucauugaagagaugccccucaacguugcugac
cucauuugagggggcuguccugcgaccuggcccuagcccaggguucaguccuggggugggcuaaggaagagcuggagggg
gaggggaggagccaagggauggcacaucuuguuuugguuuggcuuuuuuuuuuuuuguuucaguuuuuuuucucuau
gaauaaaugucacuuuuugaggc 216 AW049795   uuuuuuuuuuuuuuuugccaggauauauuauuacugaaaguacaagcaacugagguuu
              acccugggaacaccccacaaugaaacguguaucuucccuguuucucagaugcugcuccuu
              ccacagagugagauuuucguuuaaaacucauaauggaggagaaggcagggggcuccacccu
              uuccuguucaaucugaagacugaauugggcuacacugggauggagauuucaggucugca
              ggucaguguucaaccaagggguucguguugucaggaacucuggcugguaagaugacacaaagg
              cuucaugcugaagcucaggaggggccagggagccuggcagaauggaaucaucauggucau
              caucaaacgucuguguucuggaaggcuucaaggcucauaauugcaacauuucucuggcaguu
              ccugagagagcugccccuuccugggduuugcacgcaucaaauuucacccacuggauaauga
              cacaguuuugagcuucgggacaaucucuuaaucagguugugggauggauggugagaaaaacc
              caaagaagucggcaccgcauga 217 D87691    Sequence below.
auuguaacagaagaaggaaaggaaaagaaaguuaacauugacuuugaaccuuucaaaccaauuaauacaucauuguauuugu
gcgacaauaaguuucauacagaggcucuuacagcguuacuuucagaugacagcaaguuuuguuuuauugugaauagacggaa
guggugcucuuuuuggcacgcgucaaggaaacaccagagagucgcugcacaaaucacguggaucuccaaaggaaacacgg
cagaggaggucaaucagccuugcguuuugcccguuuaagaauggaaaagagacauuaacuauguucgaaagugccgagacu
gcugugcagcuguuuauuucuggagaccaagugaaugugcggguuuguuuuagcuggaucagcugacuuuaaaacuga
acuaagucaaucugacauguuugaccagaggugcaaucuaaaguuuaaaauuaguugauauauccuaugguggugaaaaa
uggauucaaccaagcuauugaauuaucuacugaaguucucuccaacgugaaguucaucauucaagagaagaaauuaauggacga
uauuuugaugaauuagccaggacacaggcaaguacuguuuugguguuugaagauacacuaaaggcuuuggaaaugggagcu
guacaaauucuaauagucuaugaaaaaucuggauauaaugagauacguucuucauugccaaggcacagaagaggagaaaauuc
ucuauuuaacuccagaacaagagaaggauaaaucucacuucacagacaaagagacuggacaggaacacgaacugauagaaagc
augccucucuuggaaugguuugcuaacaacuauaaaaaaucuuuggacaagaaacaugcacagaauaagucacaagaag
gaucacaguuugugaaagauuuuggugaauuggaggguaucuugcgguaccgaguagauuucagggaauggaguaccaag
gaggagaugaugaauuuuuugaccuugaugacuacuaggagucgacaugggguccggcaaccgugccucacccuccagcau
ucaacccaaggagcauacccgguggagccaacagaucccugccuuacaauuggagcauuuccagaacuuaauccgugag
cauuggaucugaaaagaaaagugaaacaaaaccagacccaacccuacacuuugguuugucgguggugucagcgcagcagccg
acaacuaagucucu 218 AI117211   cagaggagucauuguugcuguggugcuuuugugaugaagaggaggagaaacacagcgua
              agccagcugccuggagugggacuaagugacagacaaugucuucacacaucuccugugacau
              ccagagcccucaguuuucuuuagucaaguaucugaugaucccugugagccuauggggucaa
              agugaagaacugugcagcccagccugccugccugcacacagaacccugucccugcacugcccu
              gggguuccuuccacagccaaccuugcugcuccagccaaacacugggcgacaucugcaucc
              ugccagcuccaugcugcccugagcugcagcuccucacuuccacacugagaguaagaaucu
              gaaugggaccuugauucuuaacauccugaccgaggguugauuucuuguuaauuucaugga
              uugagaauacuuagaguuuugguuugucuugauuuuuuuucaag 219 Y00520    ugaauaaaacgaggagccgaagauucuaggggcuacagcugcgcuuuugcagcacuga
              acaugguuccgggacucaagauauugcguuuguuuuggagggguaguguagauu
              ccagccgagaagaccaggaaaagauaaggauaaagaaugucauauaucucaggagcuaga
              ucacuucccgaugaacaaguaagaauugccucaacaaaaaugggaugggaauuggaccgaaa
              aaagccauucagcuucguuaucgauuaggguaucagugggaacaucaagaugaaugaguua
              acuaaguaucagaucgaccaaauugaacaaaugaacaauguuguuuuaauugggguuuaauugg
              gaauugaagagggggagaacgagcagacaucgaacgauuaauuucuauuuucguuaucgu
              ggaauucgucaucaagauggaucgcccuuacgcggucaacgaacucauacuaaugcaagg
              acugcucgcaagcaaauucggaaaugaaagaaggcuaccgaaagaacaagcaacggauuu
              cgcgcucauccccuugcuaaagcgcauacguuuucugucucccuuggacuugucugaucaa
              ucacacguucauuaguucacuugauuuuucguucgaugucuugaaccgcuuacuaaauca
              cguauacguauaguaggcccccuucgccacuccacgucuggcccgucuuggucucgcuca
              cuucgcccgccuaucguaucggcucggcuucgucgucaagcgacagcuucugccucuga
              cggcuucacuaucgcucaugacugguaguacucuauguaguagucggccuuuguuaagcuu TABLE 3-continued RNA transcripts up-regulated during HF stem cell activation.

SEQ
ID
No:Access. # Sequence

220 AA638002  uauaaccauguuagaagcggaaguuggccugaaaaccugaggcuuaggcuucauagcugg
gcuguagauuggauuuaaacccaguuggagugcaaagucauggugugcucaaggugauga
cagugaacagaguaug 221 Z22661  caugggccuccugagaga
uccuuagauccagguuagugcauaggaaagugucccccacuaccuacagcuaagggauu
ggggugguggaucauggugagggccguggugaauacuagcgaugucccccgcuacccg
ugcgucugccuccaggugcccucccaaccaggaugaggcucuucaucgcucuuccuguc
cugauuguggucguagccaugaccuuggaagguaagaaagagccuuggaagguaagaaag
augcuuggaagugugaaguuggccuugugccugcggcccaggcuuagaagacccucgagg
agggcucugaggucccuuucuguguccaucauuccacuaccgcccucccaucgucccccau
cccaccugccaggugccuuauuuugugucaaaguggggugcugaaggaggcaacucuguc
cagaaaagacgcaguaaccaaugaccuaggauaccaccccuuuggaauuggcuaaucuucc
uagaaggggcggacgguaaaaacaaggaggugagaggugcaguaaaaaucaagugucccaau
accccuccccaugcuaaugaguuugcucgcaaccccucucgcggcaggcccagcccccgcc
caggcggccccggauuugugccggaacauuggagagcauaccggauaaacugaaggaguuu
gggaacacuuuggaagacaaggcccgggcagccauugaacauaucaaacagaaggaaauu
uugaccaagacccg 222 X99644  Sequence below.
cagcgccuggggcgcggcgggcgucggcccaggagacgcguggcggcgcucggccucgcggcaucggcggcugccuggccg
uuggcggcgagcgcacuugcgccugcgcagcgggguccgugcccucuccccuggcggccccccaccccccggcggcg
ugugaauggcggccucggcggcagcgacugcagcggccucggccgcgacggccgccucgcggcgcucugguagcccagggc
gggcgagggcucggcgggcggugagaagcguccggcucuuccucagccgcggcuccgcagccgcgcgucguccccugc
gggggggcgguggcgaggcgcaggagcuucuggagcacugcggcgugugucgcgagcgccugcggcccgagcgggauccucg
gcugcugcccugucuacauucggccugcagugccugccuggggcccgcuacaccccgccgcagcgaauaauucggggggauggc
ggcucggcgggcgacggcgcuaugguggauugucagugugcaaacagcagugcuauccaaagacaucguggagaauuau
uuuuaugcgugauauguggcaguaagggccucuucugauuccaggaugucaacagugccgcacuagcugugaagauaaaugcc
ccagccacuagcuauugugugggagugcucguaaccacuuugugagaccguguggaggcucaccagcggguugaaauacacca
aggaccacacugugcgcuccacaggaccugcuaagacucgagauggagagcgaacagucuacuguaaugugcacaagcauga
gccccucgugcuguucgugagagcugugacacacucaccugccgcgacugccagcucaacgcucacaaggaccaucaguac
caguuuuuggaagaugcaguaggagaaccaacguaaacucuuggcuucacugggugaaacgucuuggggacaaacaugccacac
uucagaaaaacaccaaggagguucgaagcucgauccgccaggugucugaugugcagaagcgagugcagguugaugucaagau
ggccauucugcagaucaugaaggagcugaauaagcggggucgaguucuggucaaugaugcccagaaggugaccgagggguca
gcaggaacgucuggagcgccagcacuggaccaugaccaaaauucagaagcaccaggaacacauuuugcguuuugccucuugg
gcucuggagaguaaacaauacagcucucuuugcucucuaagaagcugauuauuaccagcugcaucgggccucaaaauga
uugugauccuguggagccucauggugagaugaaguuucaguggggaucucaaugccuggaccaagagugcugaagccuuug
gcaagauuugggcugagcguccuggugacgaacuccacaggguccugggccauggcuccuccaagagccccaggcccucuaag
caagcaagguucuggcaguagccagcccauggaaguacaagagggauauggcuuuggggucagaugauccccuauucaagugca
gagccgcauguaucaggcaugaagcgguccccgcucuggugggaggcuuugcucuuuaaggaagguugccacgugugugug
agccuugaacgccuggaucuggaccucaccucugacagccagccaccagucuucaaggucuuuccuggaagcacuacugagg
acuacaaucugauuguuauugagcguggcugcugcagcagcugcuggucaggcugggacugugccaccaggagccccug
gugcccacccccuuccuggcauggccauugucaaggaagaagagacagaagcugcuauuggagcuccccggcugccccga
gguccugaaaccaagccuguguguaugcucucaguaaggucucagaccuagcucucaagggacggcgccucagcugguc
caguaccagcucaggcuuggagguggugggcuccugagguuacuucagccccaguaaguggccagguauccuggaugacag
ugccacuaucugccgagucugccagaaaccaggugaccuggucaugaauaccaguaccgaauuuugcuuccaccuggauug
ccaccucccugcccugcaggauguuccaggggaggaauggagguugcucacucugccacgugucccugaccaaaggaggaa
gauggaagccucagccuggauggagcagauagcacugguguggagcuaaaacucucaccagcaaccagcggaaaugugagc
ucguucucuggcccguucugccaugaaccaugccguccccuugcaucagcuggcuaccgacucuacaucuugaccauggagca
gccuggugguacccuagaccugaccuugauucugcucgccuccaagagaagcugucaccuccuuauagcucccccccaggag
uuugcucaagaugugggccgcauguucaaacaguucaacaagcugacugaggacaaggcagauguucaguccaucaucggcu
ugcagcgcuucuuugagacacgcaugaugaugcgcuuugugacaccaaguuuucugcugugcgguagaaccaccaccau
ugaaccuuccagugcuggccuaaguucucaggagcucucuggccugaugccccgaagcuggggcucuguguc
agccagcucagcucuggucucuguauuucaccccauacccuguccuuugguggccugacuccuguucuugcuggcccca
ucgucccccucaguccccuucacaaaaugguuuuuacuucguggauuuaauaaaaacuucacugagucaguuaaaaaaaaa
aaa 223 AI843895  uuuuuuuuuuuuuuuuaaaaauaauuucauuuuuuaauauucuguacaaaauuucucaa
ccuaugaaaauaaaguuugcaaagucaaaguaguacaugggcugcccuggagccaggc
ccagccggaucuacacuauguacaggucucccagggugagccucagcuagggaaaagcca
cuaaggugccuacagagcaagaggggugccaucgggccuggccaguagcgcucugcaauuuccag
aucugccacuagaggucggcaugguccugauugcuugucaggcucaccucuggaagacc
acagccaaugacaaaggccucaagggaaagcuuugggucuagcuggaagugacggugg
guccgccgccaggcgcaggagcaucugcuggcaguccagcaguaaccgguugaucgccaa 224 M38724  uccgucguaaccuguugaguaacuauggaagacuauaucaaaauagagaaaauuggagaa
gguacuuacgguguggugauaaagggugacacagagucacuggccagauaguggccaug
aagaagaucagacuugaaagcgaggaagaaggagugcccaguacugcaauucgggaaauc
ucucuauuaaaagaacuucgacauccaaauauagucagccugcaggaugugcucaugcag
gacuccaggcuguaucucaucuuugaguuccuguccauggaccucaagaaguaccuggac
uccaucccuccuggggcaguucauggauucuucacucguuaagaguuacuuacaccaaauc
cuccagggaauuguguuuugccacucccggcgaguucuucagagacuugaaaccucaa
aaucuauugauugaugacaaaggaacaaucaaacggcugauuucggccuugccagagcg
uuuggaauaccgauacgaguguacacacacgagguagugacgcugugguaccgaucucca

TABLE 3-continued

RNA transcripts up-regulated during HF stem cell activation.

| SEQ ID No: | Access. # | Sequence |
|---|---|---|
| | | gaaguguugcugggcucggcucguuacuccacuccgguugacaucuggaguauagggacc auauuugcagaacuggccaccaagaagccgcuuuccacggcgacucagagauugaccag cucuucaggaucuucagagcucugggcacuccuaacaacgaaguguggccagaagucgag ucccugcaggacuacaagaacaccuuucccaaguggaagccggggagccucgcaucccac gucaagaaccuggacgagaacggcuuggauuugcucucaaaaaugcuagucuaugauccu gccaaacgaaucucuggcaaaauggcccugaagcacccguacuuugaugacuuggacaau cagauuaagaagauguagcccucuggauggaugucccugucugcuggucguaggggaaga ucg |
| 225 | AW122989 | uuuuuuuuuuuuuuuuuacuaggcaaagaauuuuauuaacccuuuccaaacuuuauuccc aggcuucuucagcuuuauuugccgcaaagaaugaauuagguauagcgaaaacugaaaaga gcugcaguguccgggggcuugggcuuaaaaauauuagagaaucuagauuuuaucagaucca uaauaaacaaaaaaauuuuaaaaagcagucaugauauaaaauagcagcuccuguaauuuc ugcaaguaucaccuucuucagaaguugcuucaauucaguuugccucauucuuagaagccu caucaaaauucuccaccagaucuggaacuucaucaucaucaucuccucccaguagcaaggg gugcuuuuccauccacagauuguuugggcagagcuucagccagucuccuuaaacuaguca ggcugucugcaccaagcugguugaggaugcugggaagcauuucugucagcugcuuuguc |
| 226 | AI844810 | uuuuuuuuuuuuuuuuauuucaugcuugccuagggauggggaauagaucauucaauaaaa acauacaguaaaaacaggggguggggagggggaaggcuuaucaugcaauguuuuaaacu acaauagugauguaccuuaauuacuuccaugcacacaagucuaacauuacaaguuuuuaa aaaauaaacaccauuaagacuucuaggagcauuuuauaauaaauuccuaauuuuuucuuu guagauagaucaagcaccuccaaaauacagauuccuauacacagugagcacuuuuacuuaa cguacauggacagccucaggacgagcugacgucucggaucagcucggcaggcaacaaacc auagugccaaauggaaagaagggcaguugcaaauaaacuuaaaacuaaguuaacuuuuau aauuaaauacagaaaauauacugauuugcuaaaaauaaauaagaugugauguauuuaaca cuucacuauaaagaaugaacaccaugacauccucgugccg |
| 227 | AA940430 | agaagaaggaggaguggggaccgcaagcaugaggaugcuaguagggaguaugagaaaggca ugaaagaguaugaaggaggaagagggggacucaucuaaaagggacaagcuaagaagaaaa agaaaguaaaagcaaagauggaaaaaaaguccacuccuucccggggcucgucauccaagu cuucauccaggcaguugagugacagcuucaagagcaaagaguuugccagugaugaga gcucuucaggcgagaacaagagcaaaaagaagaggaggcggacgaggacucugaaggaga gcuagccaguaccccuccaagcucagaggacucugccucgggaucgaugaauaaaggag ggaauucccaccccgucacagcuccagucucucacauagaccuuggauucuguccaucu gaguaacugcucugguggcuuccacugcccugaggcuuugagggaag |
| 228 | M38381 | Sequence below. | aucgucguaaucguuugcagacuucucgccgucgccuuguaagcuuugucuucgccuugcaagcuuugucuucaggguug
gaaagaugagacauucaaagagaacuuacuguccugacugggaugaaagagacugggauuuaugggaacauggagaagcagcag
cagucacaaaagaaagaagagaucacauagcagcgcccgugagcaaaagcgcugcagguacgaucacuccaaaacgacagaca
gcuauuaucuggaaagcagauccuaaaaugagaaagcuuaucauagucgacgcuauguugaugaauacaggaauugacuacau
gggcuacgagccagggcaucccuauggagaaccuggaagcagauaccagaugcauagaugcaaguccucugguaggaguggaa
agaagcaguacaaaaguaaaacaggagucgccaccacacaucgcaaccagccacauccacggaagaguccacacggaaggaaaga
ucgaggaguguagaggaugaugagggagggucaccugaucugcagaguggagacguacuaagugcaagauaugaaauuguu
gauacuuuaggugaaggugcuuucggaaaaguggugaaugcaucgaucauaaaguggagguagacguguagcaguaaaa
auaguuaaaaaugugggauagauacugugaagcugcucaaucggaaauacaaguuuuggaacacuugaauacaacagacccc
auaguacuuuccguugugucccagaugguuggaguguuugagcaucgaggucacauuugcacauuuguuggaacuucugggg
cuuaguacuuaagaugauuucauuaaggaaaacaguuuuucugccguuucgaauggaucauaucaggaagauggcauaucaaua
ugcaaaucuguaaacuuuuugcauaguaauaaauugacucaucagacuugaagccugaaaacaucuuauuugugaagucu
gacuacacagaggcuuauaaucccaaaaugaaacgugaugaacguacuauaguaaauccagauauuaagugguggacuuug
gaagugcaacauaugaugaugaacaccacagcacauugguaucuacaagacauuauagagcaccggaaguuauuuuagcccu
cgggugguucacagccaugugauggugcauaggauguaauucuuaucagguauuucagguauuuacaguuuuuucga
cucaugauagcagggaacauuuagcaaugauggaaaggauucuuggaccacuaccaaagcacaugauacagaaaaccaggaaa
cgcagauauuuccaucaugaucgauuagauuggugaugaacacaguucugcuggcagauauguuucggcgcuguaaaccu
cugaaggaguuuaugcuauccuaggaugccgaacaugagcuucucuuugaccucauugggaaaaauguuggaguaugauccc
gccaaaagaauuacucucaaagaagcccuaaagcauccuuucuuuuuacccacuuaaaaagcauacgugauuuauaaacacagu
gcucugaaggaaucuuacagcuguaucagucuagcuuuuaauuaaguauuuuuguauagcuuaauuuguaaaacauuuu
augcuuuuuagaugcuuuuauuaaauacauggccaaaccaaauaacaucuuucaguaauuauagaaugauuuauuuggaaua
aaauuugugcuuaugaauguaaaaaaa

| 229 | AF014371 | ggacucgcgacaagcguccucagcgcgaagaggcggacucggaguccucgccuugagccu ugcaucugagaaguuccagguacuuuguacaacugcauccagaaccugugaguguuuucag caccuuuauaagugauggcugccaucaggaagaaacuggugauuguugguaugaggagcuu ggggauaagacaugcuugcucauagucuucagcaaggaccaguucccagaggucuaugugc ccacggugguuuuaaaacuauggcggauaucgaggauggaagcaggagaguugg cuuuaugggacacagcuggacaggaagauuaugacugccugaggccucuucuuuauccag acaccgauguauauaugauguguuuuucaaaaucuagaaaaacaucc cagaaaaauggacuccagaagucaagcauuucuguccaaauugcccaucauccuggug gaacaagaaggaccuucggaugacgagcacacgagacgggaguuggccaaaaugaagc aggagccguaaaccugaagaaggcagagauauggcaaacaggauuggcgcuuuugggu acauggaguguucagcaaagaccaaagauggagugagagagguuuuugagauggccacga gagcugcucugcaagcuagacgugggaagaaaaaagucugggugcccaucucuugugaagcc |

TABLE 3-continued

RNA transcripts up-regulated during HF stem cell activation.

| SEQ ID No: | Access. # | Sequence |
|---|---|---|
| | | uugugaacgcagccucaugcgguuaauuugaagugcuguuuauuaaucuuaguguaugau uacuggccuuucauuuaucuauaauuuaccuaaga |
| 230 | Z30939 | uucaagaccgaccugcgcuuccagagcucggccgucauggcucugcaggaggcgagcgag gccuaccucgugggucuguuugaggacaccaaccugugcgccauccacgccaagcguguc accaucaugcccaaggacauccagcuggcccgucgcauucgugggagagggcguaaauu agguaguagaqugaauuuggaccccaaaggcucuuuucagagccacccacauuuucuaua aaaggcuguauaucgauaagcuuuuauaaaccccacucagcaacucc |
| 231 | U28208 | uuaugugauaaaaaaauucaacuugguauuaacuuaacuaagggccuuggugcuggugcu uugccugauguugguaaaggugcagcagaagaaucaauugaugaaauuauggagcauaua aaagauagccauaugcucuuuaucacagcagggauggguggugguacuggaacaggugcu gcaccgguaauugcaaaagcagccagagaagcaagagcgguaguuaaagauaaaggagca aaagaaaaaagauacugacuguuggaguuguaacuaagccguucgguuuugaaggugug cgacguaugcgcauugcagcuuggacuugaagaguugcaaaaauacguagauacacuu auugucauucccaaucaaaauuuauuuagaauugcuaacgagaaaacuacauuugcugac gcauuucaacucgccgauaauguucugcauauuggcauaagaggaguaacugauuugaug aucaugccaggacugauuaaucuugauuuugcugauauagaaacaguaaugagugagaug gguaaggcaauugauuggacuggagaagcagaaggagaagaaugaagggcaauuagugcugca gaggcugcgauaucuaauccauugcuugacaauguaucaaugaaaggugcgcaaggaaua uugauuaauaauacuggugguggagacaugacucuauuugaaguugauucugcagccaau agagugcgugaagaaguggaugaaaaugcaaauauaauauuuggugccacuuuugaucag gcgauggagggaagaguuagaguuucuguucuugcaacuggcauugauagcuguaacgac aauucaucuguuaaucaaaacaagaucccagcagaggaaaaaauuuuaaauggccuuau aaucaaauuccaacauuagaaacaaaagaauaugcuucaacugag |
| 232 | AV218217 | ugaucaggucacauuccggugccuuccaccccuauggcacgggcgccccgccuugccau accacagcucccuccaggcuuagaccuggcuucaccgcauuucaggugcuauacccccc cugcuuuuccccccauugcccuuaaaugccccucggcccucccauccccccggaacaggg uggcacuugccacucucaggaccaccuugccaaggagaauaaaccgaauccuguugcu |

Thus, the transcripts identified in this Example, the proteins they encode, and the pathways in which the proteins participate contribute significantly to HF stem cell activation. Accordingly, anagen can be induced by activation of these transcripts, proteins, and pathways.

Example 9

Molecular Pathways Activated During Induction of Epidermal Cells to Differentiate into HF Stem Cells The gene expression pattern of HF stem cells was analyzed as described in Example 8 and compared to non-bulge basal keratinocytes. 157 genes were differentially expressed in the HF stem cells, as assessed by microarray analysis and quantitative polymerase chain reaction (qPCR). A group of selected genes with increased expression in HF stem cells is depicted in Table 4. A group of selected genes with decreased expression in HF stem cells is depicted in Table 5.

TABLE 4

Genes up-regulated in HF stem cells. Numbers in parentheses are the fold increase as determined by quantitative real time PCR.

| Gene Name/ Protein name/ GenBk Acces #. | Fold Incr. | Sequence | SEQ ID No. |
|---|---|---|---|
| Cell surface proteins | | | |
| Cd34/Cd 34 antigen AI847784, AI173145 | 43 (189) | uuuuuuuuuuuuuuuucacucaucacguuuauucagaagagaauacac ccaauccucucaucucuggaaaguuuuguuccuagccaucauuaagauc aggaccccuguucuccccuuaaccccaggagaggaagcuuauagucuuu guagauauucgaaccucugaucacaaagggguuauaaaauagugaaggg guuuggacuaggaaaggcacagacugaaaggaaucugccaggggacuga | 233 |

TABLE 4-continued

Genes up-regulated in HF stem cells. Numbers in parentheses are the fold increase as determined by quantitative real time PCR.

| Gene Name/ Protein name/ GenBk Acces #. | Fold Incr. | Sequence | SEQ ID No. |
|---|---|---|---|
| | | ggccacagcuccccaggagucagaggaaggggggaagucacguauuuua<br>uagaaggccaagggccucagagcaagaguauuccuuugaagagcuca | |

Calcium-related

| S100a4/<br>S100A4<br>(mts)<br>X15986 | 35 (144) | ugguggagcaggucucaggaaucucuucgcuucagcuucaaucauggcc<br>uguggucuggucgccagcaaccugaaucucaaaccuggggaaugucuca<br>aaguucggggagaggugguccucggacgccaagagcuuugugcugaaccu<br>gggaaaagacagcaacaaccugugccuacacuucaauccucgcuucaaug<br>cccauggagacgccaacaccauugugguaaaccaaggaagaugggacc<br>uggggaaccgaacaccgggaaccugccuucccuuccagcccgggagcau<br>cacagaggugugcaucaccuuugaccaggcugaccugaccaucaagcugc<br>cagacggacaugaauucaaguuccccaaccgccucaacauggaggccauc<br>aacuacauggcggcggauggagacuucaagauuaagugcguggccuuug<br>agugaagccagccagccuguagcccucaauaaaggcagcugccucugcu | 234 |

Transcription Factors and related genes

| Id2 helix-<br>loop-helix<br>protein<br>AF077861 | 11 (25) | gugguucuucggcgccagguucgcccgcuucugcccuuagguaacauuc<br>ucuaaacugcguuucucucccaaucuuuugcaggcauuuggggacuuuu<br>ucuuuucuuuuuacuuucucuuuuucuuuugcacaagaagaagucuaca<br>agaucuuuuaagacuuuuguuaucagccauuucaccaggagaacacguu<br>gaauggaccuuuuuaaaaagaaagcggaaggaaaacuaaggaugaugaucguc<br>uugcccaggugucuuguucuccggccuggacugugauaccguuauuuau<br>gagagacuuucagugcccuuucuacaguuggaagguuuucuuuauauac<br>uauucccaccauggggagcgaaaagguuaaaaaaaagaaaaaaaaucacaa<br>ggaauugcccaauguaagcagacuuugccuuuucacaaaggugggagcgu<br>gaauuccaggaggacccaguauucgguuacuuaaaugaagucuucgguc<br>agaaauggccuuuuugacacgagccuacugaaugcuguguauauauuua<br>uauauaaauauauauauugagugaaccuuguggacucuuuaauuaga<br>guuuucuuguauaguggcagaaauaaccuauuucugcauuaaaaguaa<br>ugacguacuuaugcuaaacuuuuuauaaaaguuuaguuguaaacuuaac<br>ccuuuuauacaaaauaaaucaagugugguuuauugaauguugauugcuug<br>cuuuauuucagacaaccagugcuuugauuuuuuuuaugcuauguuau<br>aacugaacccaaauaaauaccaguucaaauuuauguagacuguauuaga<br>uuauaauaaaaugugucugacaucaa | 235 |

| Id4<br>AJ001972 | 4 (12) | cgaugaaggcggugagcccggugcgcccucgggccgcaaggcgccguc<br>gggcugcggcggcggggagcuggcgcuacgcugccuggcggagcacggc<br>cacagccugggugguccuggcagccgccgccgccgcugcggcggcgcg<br>cugcaaggcggccgaggcggcggccgaugagccggcgcugugccugcag<br>ugcgauaugaacgacugcuacagucgccugcggaggcucgugccuacca<br>ucccgcccaacaagaaagucagcaaaguggagauccugcagcacguuauc<br>gacuacauccuggaccugcagcuggcgcuggagacucacccugcuuugc<br>ugagacagccgccaccgcccgcgccaccucuccaccggccggggcuugu<br>ccggucgcgccgccgcggaccccacucaccgcgcucaacacugacccggu<br>gagaagccuuggcgggcacccuggggcaucgcgggaaaggugggcgggggcg<br>gcgagauacgggugucuugcuccucucagggaaugacagccgcuucuc<br>ccgucuccaccgagagccgccugcugggcuugguugauccacuggucccu<br>gagccgagggcgguugggcuuggagcccugcgucuccggaguccuu<br>gcaucacaggaggcuuccccagcuucgggcucgggugggacucugcuc<br>accugccuaguuuuccaggacgucuccuggguggugugcgacacugugau<br>augcgcacucuaaccgcuuuuccccuuggguguuggguugcuguuccagg<br>ccggcgccgugaacaagcaggggugacagcauucucugccgcu | 236 |

| Peg3/<br>Paternally<br>expressed<br>gene 3 zinc<br>finger<br>protein<br>AF038939 | 12 | Sequence below. | 237 | acuagucucgaccauguaccaucacggagacgacaccaacagugacaugaacagugacgacgacaugagccgaagugggagag
aaaccccaccccucgaccaucucaugcuuuuggcagugagcgagaccggagcgcaggggcagaagcagagaugugggagcc
ucgagaccgcuggccauacaccaggaaucccagaagcaggcugccucaacgggaucuuucucuuccugugaugucaagacca
cauuuuggacuggacagagaugaugacagacguuccauggaauugaugagucucgaucccaggaugcgagucauaaccagaaug
uuguggaacucaaagaggacaagaagccucagaauccaauucaggcaacuggagaacuacagaaagcugcucucgcuggg
aguccaguugccgaagaugaccgacacucucacaugacacaaggccacucaucgagguccaagagagcugccuacccaagca
ccagccgaggucucaaacccaugccugaggccaaaaagccaucccacaggcgugggaucugugaggacgagucuucucaugg
agugauaauggaaaaauucaucaaggauguggcucgcaaccccaaauccggaagagcaagggagcugaacgagcguccucu
ccaagguucccaggccuaaugauaacuggaaggacaguuccuccagcagaagagaguagcagugauccaggagaggggguauag

TABLE 4-continued

Genes up-regulated in HF stem cells. Numbers in parentheses are the fold increase as determined by quantitative real time PCR.

| Gene Name/ Protein name/ GenBk Acces #. | Fold Incr. | Sequence | SEQ ID No. |
|---|---|---|---|
| | | aagggagcgcauuuaggggcggcuuccgguucaacgcagaccuggcuuccagaagcagagcucuagaaaggaagaggcguua ccacuuugauucugaugagcggggguucgggccaugagcauaaaagcugugugaggaagaagccuuuugagugugggugcuga gaugagacaggcuaugagcaugggcaaccugaacagcccuuccuucucugagucgcagucaaucgauuuuggggccaaccca uacgugugugaugagucggggaggcaguucagugucaucucugaguuguugagcaccagaucaugcacacuagggagaac cucuaugaauauggagaguccuuuauucauagcguggcugucaaugaggugcaaagaagucagggugggggaaacgcuuu gaguguaaggaaguggagaaaccuucaguaggagugcugcccuggcagagcaccgccaaauccaugcuagagaauaucuug cagaauguagagaucaggaggaugaggagaccaucaugccuagcccgaccuuuagugagcugcagaagaugauauggcaaaga uaaguucuaugagugcaaggugugcaaggagaccuuucugcacaguuccgcccugauugagcaccagaaaauccaugguaga ggcaacucagaugacagagauaaugagcgugaacgcgaacgugaucgucuacgugcacgugcacgagagcagcgugagcgcg aacgugaacgggagcgugagcgugagcuuugggaacccuuucugaccugucaaacuucaaugaguuucggaagaugauaca ggaaagacaaaaucuaugagugcaaagugugugggggagagcuuucuucaucucucauccccugagggagcaucagaaaaucca uacuagaggaaaccccauuugaaaauaagagcaggaugugcgaggagaccuuugucccuagucagucucuccgacggcgccag aaaacuuacagagagaagcuguucgacuuuaacaaugccagggaugcacugaugggaaaacucagacuccagcgagcaucaga aaaccguucccgaaggaacuucuuugagggcagaggauuuggaaaccucguugaaucucagaagagucauacuauaac aagaccaccugaaaacaaagacgaugacaagccguucacaaucagugucaacccuaaugcaagcugaaacucccccaucaugg aaaauggcucccagggcaaauccugugagaggucuguuauucauagcuugggcuccgcagaagcucagaagagucaugggug gacugggguucaguaaaccaagaccagugcagagucuagcacccagagcucaagcagcauuuacuaccccagagcacacucu ggaggcaacaccuaugaggaaaaagaaacaaggacucuaucaucccauagcuugccagccuccugaccucugaaacgucauag agcaaaugaccauauucaaugugaugagggggggagaauccuccauuuauaucccagauauuauuaauaagggaaggaagauu ccugccagagaagaugcuuaugaaggaaguagcagcagcaacuaccacacaccaaaugua ccgugcugagccuccaagucu uucuggagaguccccaugacucuaagcaggaugucacguuucaguucccagcucaagguguucgugaacaccagaaagcucgu gccaaaaagaaguacauugagcccaggaacaacgagaccucuguuauccacuccuuuuugggugaguugcuugcaggc accguagggcaaaguucuuugagugucaggaaugcggggaggccuuugcucguaggucugagcucauugagcaccagaaga uucaugauagagaaagaccuucuggaagccgacauuaugagcgcucugucauccgcagccuugcgcccagugaccucagac caguuaugcccaagaacguuucauccaagaacaagugcguaaauucagagcguuggacaacgcucaacuaccagcaacaacc ucagugaacagaaaaucuaugcccaagagacauuuaaugccgaggagccccaugauaaagaaacucauggucaaaaaauucau gacaaagagcauauggaaggagcccaguggcaaggagcccacauggugugagcccaggcacaaagaaccccuuguucagg agaugcgcagugaagagccccaugaugauaagccccauggccaggagccccaugaugauaagccccauggccaggagccccau gaugauaagccccauggccaggagccccacgugaugagccccauggccaggagccccacgugaugagccccaugacaagga acccauugaucaggagaugcgcagugaagagccccacagugaagagcucauggugaugagcccauggugaagagccccau ggccaggagaaaguugaagaugcuaccaucaggcccucaguuucugaagagcaaaugaaaugacgcuggugaugcaaucu augaaugccaggacuguggcugggcuuuacugaucuaaugaccucacaagccaccaggacaccauagcagaaaggcucu gguugacagucugaauaugcacauucugaaguucaugcccacuccgucagcgaauuugagaaaaaaugcucuggagagaaa cuauaugaauguccaaaaugugggggagucuuucauucacagcucguuacuuuucgagcaccagagagucacgaacaagacc agcuguauuccguaaaggccugguaaugacgcuuuuaugaccucaugggugcccguuaugcagacaauugcacuguugaaa ggaauccugccguuucugggucagccauucgaugccgucaguguggacaaggcuucauucacaguucugcccuaaaugagc acaugagacagcacagagauaaugaaauaauggaacagaugagcuuucagaugagauuucauucaaggccuagcccucac ugaguaucagggagugaaacagaagagaagcuuuucgagugcacaaucugugggaaugcuucuucacugccaaacagcuc ggggaccaccacaccaaaguucacaaggaugagcccuaugaguaugggcccuccuacacccaugccuccuuucucaccgagcc ccucaggaagcacauccacugnacgaaugcaaagaauugcggccagccuuccuagacgacaucugucagcugagcgcagg guguuucauccugagcgagaaggugggucagaaauaguagcugccacugcccaagaggucgaagccaaugccucauccac aagaaguacugcgaauccaggggucaaaugcagaagcugcugagcccgaaguggaggcugcagagcccgaggugaggcugc agagccugagguggaggcugcagagccuauuggagaggcugaagggcagauggagaagcugcugagccugauggcgaggc ugagcagcccaauggagaggcugaacagccaaacggugaugcugacgagccagacggagccgggaucgaagacccagaagaga gagcugacgagccugaggaagacgcugaaggccagagggaugacgaaggacagaugagcccgaguggcagacauugaagacccaga agagaaggagaagaucaagagauugaggugaagaaccauacuacaacugucaugaaugcgcagaaacguuccgcuuccagc ucagccuuuggcgagcaucugaaaagucacgccagugugaucaucuucgagccggccaaugcccuggagagugcucugc uacauugaacgggcaggcaccagugcaggagugcgggagcaggcagacgacaaguacuuccaaugugaugugugcgggcaac ucuucaacgaccgccucuucccugccagacaccagaauucucacacugguugaguaaccaggcugaagaaaagaagagcaaag ccaaaccuuccuuccccagaaaccagaccccuuuaaaaauacacaaagggagcccaaaaucaauauugaauaagaaaauucaccu uccuguauacauaccggacuucacaucaaagacuuucacucucaucacagacugaaaaaagaaaagacauugaacgcagggac ucuuucaguuuuagcuguuccuuauggaaucacaaguguauauuugggaaagcuagagugaacauucuacaucuuuccauuca ucuaaguaacuagauugagggaaaccuagugacaauuccagaccacagagguugcccagucgacuguaaaugauaccccuu ucauacccuauacauaaugauuccugccauguauauaaaugagcaaaucagugauacauauauuuggauuuugagugcuau agaauuuacaguuuacucuacagagcuaccuagcguggcuacucaguuuuuuccccggaggagaggagcaacaauuuagc auuauauuuguaaguauguccaugcagaagcuuuucugugcaucauuugaaccccauuaguaauccuuuccaguaauggagu guucugucccuacucuuuaguacccgugaaggugugggugaaagaucgugucuuugaauccggcugugugg aaacaggcauuuagcuucuacagccauuggugugcacccagacccccuugagacugauugugugguaacccuuuacaauauaug gauuugucucugugacccaaaucaaccccauccccuacauuuauauaccuuacaguggguuuucuugc | |

Growth Factors, Receptors and Related genes

| Fz2/ Frizzled 2 AW123618 | 9 (17) | uuuuuuuuuuuuuuuuaccguucuuuauuuaaaaaaauaaaauagga guccguagggugcaccccuccccccuccugagugaaggagggcacgguge aguccggaccugggagaggggaaagcccggcaggcaggcgagaccgcuuc acacaguggucucgccaugccggcuguuggugagacgagugagaacuu ccuccacgagugcagugucuugccggaccagauccagaagcccgacguga ugcccacgaugagcgucaugaggauuugaucaugaugaguaagagacuugugaaguc gggcgacaugcggggcgguaguggggccgggcaggggauggcuaggcuc uugcagugcuggcuuacccaggagcgcucccagugucucgcggaaggccu gcucauagaaguagcaggcgaug | 238 |

TABLE 4-continued

Genes up-regulated in HF stem cells. Numbers in parentheses are the fold increase as determined by quantitative real time PCR.

| Gene Name/<br>Protein name/<br>GenBk Acces #. | Fold<br>Incr. | Sequence | SEQ ID No. |
|---|---|---|---|
| Dkk3/<br>Dickkopf 3<br>AJ243964 | 6 (22) | Sequence below. | 239 | ggccgcgucgacgccucuccagcugcucuguggcagcccagcuaccggucgugaccagauccagcuugcagcucagcuuugu
ucauucgaauugggcggcggccagcgcggaacaaacaugcagcggcucgggggguauuuugcuguguacacugcuggcggcg
gcggucccccacugcuccugcuccuucccgacggucacuuggacuccggcggagccgggcccagcucucaacuacccucagg
aggaagcuacgcucaaugagaugu uugagagguggaggagcugauggaagacacucagcacaaacugcgcagugccgugga
ggagauggaggcggaagaagcagcugcuaaaacguccucugaggugaaccuggcaagcuuaccucccaacuaucacaaugag
accagcacggagaccagggugggaaauaacacaguccaugugcaccaggaaguucacaagauaaccaacaaccagagugga ca
ggugguc uuuucugagacagucauuacaucug uaggggau gaagaaggcaagaggagccaugaaug uaucauug augaaga
cuguggggccaccagguacugccaguucccagc uucaaguacaccugccagccaugccgggaccagcagaugcuaugcacc
cgagacagugagugcuguggagaccagcugugugccuggggucacugcacccaaaaggccaccaaaggugg caaugggacca
ucugugacaaccagagggauugccagccuggccuguguuguggccuuccaaagaggccugcuguuccccgugugcacacccu
gcccgugga gggagagcucugccaugaccccaccagccagcugcuggaucucauccaccugggaacuggagcc ugaaggagcu
uuggaccgaugcccc ugcgccaguggccuccuaugccagccacacagccacagucugguguacaugugcaagccagccuucg
ugggcagccaugaccacagugaggagagccagcugcccagggaggccccggaugaguacgaagauguuggcuucauagggga
agugcgccaggacguggaagaccuggaggcggagccuagcccaggagaugggcauuugaggggccugccccugugg gaguacu
aggcggagaggaggagauuuaggcccagaccc agcugagucacuggu agaugugcaauagaaauggcuaauuuauuuucc
aggaguguccccaagugugg aauggccgcagcuccuucccaguagcuuu uccu cuggcuugacaaggu acagugcaguaca
uuucuuccagccgcccugc uucu cuggc uugggaaagacaggcauggcgg guaagggcagcggugagucguccc ucgcugu
ugcuagaaacgcugucuuguucuucauggauggaagaauuuguuuaagggagaggauggg aagggg ug aagucugc ucau
gaugga uuugggggauacagg gagg agg auggccugccuugcag acg uggacuu ggcaaaaug uaaccuuu gcuuuug ucu
ugcgccgcucccauggg cugaggcagug gcuacacaagag cu augcugcu cugug gccucccacauauucauccc ugugu u
ucagcuccuaccucacuguc agcacagcccuucauagccacgcccccu cuug cuc accac agccuagg aggg gacc aga gggg
acuucucu cagagc ccc augcuc uc ucucu caaccccauaccagccucugu gccagcgacagccuuccaaauggagg gagu
gaaaucc uuugg uuuaau uauuuuucu ccu ucaaggcacgccugccacuaagg ucagcug uugcauguccccu cuaacgu
ucgu agcagu gugg ug gacacugucuuccaccgac ugcuucaauacc ucugaaa gccagu cu cgg agu gcaguucg ugu a
aauuaauuugcaggaaguauacuuggcuaauugu aggg cuagg auug ugaaugaa auuugcaaaguc gcu uagcaacaaug
gaaagccu uucu cagu cacaccgagaagcacaaccaagccagg uu gu gu agag uacagcugug acau acagacagaagaag
gcugggcugg augucaggccucagaugacgguuu cagg ugccaggaac uauuaccauuc ugu uaucc agagu uauuaa
aauugaaaguugcacacauuuguauaagcaugccu uucuccugag uuuuaaauuauauguauacacaaacaugggccc uca
aagaucaugcacaaaccacuacucuuugcuaau ucuuggacuuuucucuuug auuuu caauaaauacaaauccccuucaugc
aaaaaaaaaaaaaa

| Sfrp1/<br>Secreted<br>frizzled-<br>related<br>protein 1<br>U88566 | 6 | Sequence below. | 240 | gcacgagcagcccgcagcccgccgcgccugugcgagccgggacagcacucggccccgcgcgcuccccgccccgcgccagcccc
gccgcggcgaccugcugcagcggaggaccccaucgaucggaagucggaagcagccgcagcccgcgagccgacgggccc
gacugcgucu uu gucccc gg agg cucc gg gaag uu ug cag cggg acg cg cg ug aagg cg cg ugg g cag cccc gac gu c
gccgag caa cauggg cgu cggg cg cag cgcgcgggg ucgcggcgggg ccgccucgggagug cugcuggcgu uggccgccgc
ucugcugg ccg cgggg uuc ggccagc gag uacg acuacgug agcu uccag uccgac aucgg cucg uauc aga gcggg cgc uu
cu acaccaagcccccgc agug cgugg acauccgg gugg accug aggc ugugc caacguggg cugc uacaaga agau gg ug cug
cccaacc ugc uggag cacg agauc agagg ug aagc ag caggc cagcag cugggg ccg cugucaacaag aacug cca
caugggcacccagg ucuuc cuc ugu ucg cuc uucgc gcccg ucug ucuggacc ggcccaucuaccc gug ucgcugg cucug
cgaggccgu gcgcgacucgug cgagccggucaug cag uucuucgg cuucuacug gcccgagaugc ucaaauguagacaaguu
ccccgagggcgacgucugcaucgccaugacccc gcccaauaccacgg aagccucuaagccccaagguacaaccgugug uccuc
caugcgacaacgaguugaagucagaggccaucauug aacaucucu ggccaag cgaguuug cacugaggaug aaaaucaaaga
agu gaagaagg aaaac gg ug acaag aag auugu ccccaagaagaag aaaccc uug aag cugggg cccauc aag aag aaggagc
ug aaggcgcu ugu gcu guuccuguu ccuggaag aacgg ugccg acugu cccugccaccagcuggacaaccu cagccacaacu uucucau
cau ggg ccg caagg ug aag agc cag uaccug cug acagccau ucacaag ug gg acaag aaaa acaag gag uucaaaaacu uca
ug aagag aaug aaaaac cacg agug uccc accuuccagcug ugu uuuuaagug auacuggg gcg acuggggaaggggagug
uggc uug gggg ug aggg ug ggggc gcgugg aug acc cugg cu cuu ngggg cu cac auauug cu cu cac cca uac aguu gg
gc uuuug cauug cacc uggc ucug uuccu acag cgaaccc ucu cc cu uncc ucc auagccacauccagcu aaggc cacgg cc
u uu agauu aggaagg cu uuu uuu uuu uaaggg cug cag cag ggccagc agcg acgug caaaaggagagg cag aauccuuu
cacugagccugggg cacaaaaaacagaaaaug uunccgg uu ugg aaaaaacaaaacaaaacgg auu guaaag aacug cag acg
gacacugcucagcucaacg ugg uu cgg gacau cauuaccaaaug cuug uggagu caagccu cuacagg ua gaag agu cu
gauc auugccaag ccaggc ugcu uuuc agu uuauu auuaauccccucuu ucug ccu uagauaaccau cgccacccuucaaa
cacacacacacacacacacacacacacacacacacacacacacacac uuc ugaaaguag ccagg guauccc agu aua
gaacggg auag cuaaggg uuu ggg ugg gag gccacug cuac ucuacc uuc agcuuuug aacug gccacc uuug auagg aaa
cugaggucag auug gacacuuc uaccag uccaucggg auacaagg aug ccagg caaggg ucug cuuuugucug aagg agg
uacg uggg cau gaag ag acaug agg cau ucagg cug agaag caacag cuacuag uuuuc aacaau agaguggaag aaauga
gcaaagg uag aaau ugcaag cag uc aag cagggug auuggg gug aaaaauccau
cugucacuuucaaaag aacagcagcau aag acag gg auaaaag cccacau acccucaagg cuug uaaaagu ccacacuca
gcauuucaaag acu aacguc guug acug cccaaggcug ccc ucu uaauacaccgccuaugcaugucugug gaaggcaacuc
ugug cau gu cug ug gagg ag aug gg cc ucaugg cug ug cugg cug cccg gaaucagu auag cgug gaagg ag acagu auc
cauagcucugcuuu ucugcaaggaaagccc uuuccuuauacaugauugccuauaauucagacaaauuuaaaaucgcugcc
ugccugagcccuccaccuuuacuuuugcauucuccggucauauucuuuugagg cuaaagug cccuauccg aggag augg uu

TABLE 4-continued

Genes up-regulated in HF stem cells. Numbers in parentheses are the fold increase as determined by quantitative real time PCR.

| Gene Name/<br>Protein name/<br>GenBk Acces #. | Fold<br>Incr. | Sequence | SEQ ID No. |
|---|---|---|---|
| | | ucaaaggcuaacuaaucugcagcuuucccaagugcccagagguauuucucaaaguugguaugcuuaauaagugauguaaaua<br>uuccaguucucuuaggcagccuuacuccguugucccug | |
| Dab2/<br>Disabled<br>homolog 2<br>U18869 | 15 | Sequence below. | 241 | aauuccgaguggccgcgcggcuauuuaaguggcguuacuccgcguccucggcgcugcagccuugaggcuucgggcgcgggg
gaagucaugcuggcuccacagaagcacuagcuaguccguguacuuuguggguucuguccuuuugagaccugcccgccgggg
auuggcugguaucagugacugucuacugcuggauuuucgcuugccuucccgucaugcucaacgaaguagaaacaagcaca
accaauggccagccugaccaacaggcugccccgaaagcgccaucaaagaaggagaagaagaaaggguucugaaaagacagacga
guacuuguuggccagguucaaggugauggugaaauacaaggccaagcuaacgguauugaugaugugccugaugcucg
aggagacaaaaugagucaggauucuaugaugaaacucaagggaauggcagcagcuggucgcucucagggacaacacaagcaa
agaaucugggucaacauuuccuugcucuggcauaaaaaucauugauggagaaugcugggguaauugaacauccaguaa
auaagauuccuucauugcucgugaugugacagacaacagagcauuuggguuaugugugugaggugaaggccagcaucaau
uuuuugcuauaaaacagggcaacaggcugagccauuagucgucgaucuaaagaccuuuuucaaguuaucuauaauguaa
agaaaaggaagaagauaagaaaagguugaagaagccaacaaagcagaagagaauggaagugaggcccuaaugacccuugau
gaucaagcuaacaaaauugaagcugggguguugacagaugauguuuugggggacaugcuacaccuccugaccuaaaauagu
ccaacagaaagcaaagauauccuguuguaguggaucuaaacucugaaaucgacaccaaucagaacucuuuaagagaaaaauccauu
cuuaacaaauggagucaccuccuguucucucccucgaccaaagcucucaggcauccuucuugccugagaacgccuuuucugcc
aaucucaacuucuuucccaccccuaaccuguugaucuuuccgugaaugaucccuuugcacagccagaccaaucggcacccucuuc
guucgauucucucacaucuccagaucagaagaaagcgagucugagugcgucugucuaccaggagguaaagggcccugaac
gucgauacugauuacuuuggucagcauuugaccagcucucucuuaaccggacuggcaaaccggaagcucagggaggccguggc
ccuacccaaguucgcagacccagcaagcaguagagaaacucaaaaugggguaucugaaagaaacagaacggcuuccaucaaa
ucuucccgaaccccuuuugugggaagccuccccaaggacuaucggaccgaauggcguaaagcaggacuuggaaaguucug
uccaguccucagcacaugaucccauagccauuauccaccuccacaaaguaccaaaccaggaagaggcagaaggacugcuaag
ucuucagcaaacgccuugccugcuucagacaucuuuugcccacaagaaccucagccagauguccccacaggacaaccugcagu
cccgcagucgaacuuccuggaucucuucaaaggcaaugcuccuccccaguggggcccuuguaggucuagguacguccca
guaacacccccccaagcaggacccuggacgccuguugucuacagucuucgacaacuguggucccaggagccauaauaagug
gccagccucccaguuuucgccagccacucguuuuugguacaaccccagcaguacaaguccuggaaucagucucccaucauuuugc
aacccagcuucccccuccaccccccacaguuuggucuuccuccaacgcuuggcaucaccacaagcccuc
uggggaauccuuuucagaguaauaauaucuuuccaccuccaccaugcccacucagucccucuccucagccuaugaugcccuc
uguucuggccacaccgccucaaccaccuccccgaaauggccacuaaaggacauucccagugacgcuuucacuggcuuagacc
cccuugggggauaaagagggucaaggaagugaaagaaauguuuaaggacuuccagcugcggcagccaccucuuguccccucaag
gaagggggagacgccucccucugggacuucaagcgccuucuccaguugacuucaacaauaaaaguuggcauuccucaggagcau
guagaccaugaugauuuugaugccaaucaacuguugaacaagauuaaugaaccaccaaagccagccccgagacaaggugucc
ucuugggaccaagucugcugacaauucacucgagaacccuuucccaaagggcuucagcucaucaaaccccucuguggguuuc
ucagccugcaucuucugauccccacaggagcccuuucggaaaaucuuuugccuagccuucugaaguuaauggaugacuauc
agaugagcaaaagacuggcuuuggucaagaaugaagcagacagccagaaacauguugaccucugccucgcuccagcuuuga
cguauuaucuguuacccuauuuguuuuggccucuuguacuuggaaaugccuuucuuuucuuggcuuaggcuaaagcuaaa
cuuaaacuauggcuuuacguaaauuaagcuccuaaacucucuagcuccaauauaaaugaaguagcuucccuaucaaauccccu
gucuguugcccccuugaaacuuccagaauauuuccauucuacccuccauuugggaggagcggcuaccuuuacccuuaa
uaucacacugccuugagucaaugccaaauacucauagcucucaaagucauuuggggguucuggugugcggccuaaaccuaa
agcauccuauuaauagggaaguaagacaccuugcuuccuaugccacucagggagaauuuauuuaauaaaaugaaagcaag
acuaacuuucuacaaauccaccccaaggaccauuuugagauggucguuucucgaucuacugccacauuuaccaaucugcccaag
ugggugcuuacauuugacuugaagaagagaaagagcuaacucaaaacacaaggcauuauuucaaagcuaauaaaacaauuucuc
ccuggggccccacauuguuuucauuccagauacguugcagcuguuugacccugaugacauuaugcccuacauuuuccuuga
agauccugauuuuauuucaugugauuuuuguuucaauaaagaugauuauugugugcacggaauuc

| Cktsf1b1/<br>Gremlin,<br>Cysteine<br>knot<br>superfamily<br>1, BMP<br>antagonist 1<br>AF045801 | 12 (12) | Augaaucgcaccgcauacacugugggagcguugcuucuccuccuggggga<br>cccuacugccaacagcugaggggaaaaagaaaggguucccaaggagccauu<br>ccgccuccugacaaggcucagcacaaugacucugagcagacccaguccc<br>accacaaccuggcuccaggacccgggggcggggccaggggcggggcaccg<br>ccaugccuggagaggaggugcuugaguccagccaagaggcccugcacgu<br>gacagagcgcaaguaucugaagcgagauuggugcaaaacucagcccuga<br>agcagaccauccacgaggagggcugcaacagccgcacuaucaucaaccgc<br>uucuguuauggccagugcaauccuucuacaucccaggcacauccgaaa<br>ggaggaagggucccuuucagucuugcuccuucugcaagcccaagaaguuc<br>accaccaugauggucacacucaacugugccugagcuacagccacccaccaa<br>gaagaaaagggucacacgcgugaagcagugccguugcauauccaucgacu<br>uggauuaa | 242 |
| Fgfr1/<br>Fibroblast<br>growth<br>factor<br>receptor 1<br>U22324 | 10 | Sequence below. | 243 | guggaauauccauggagguacggagccuuguuaccaaccuuuaaccgcagaacugggauguggggcuggaagugccuccuc
uucugggcugugcugguucagccacucucugcacugccaggccagccccaaccuugcccgaacaagcucagcccuggggag
ucccugugaagguggagucucuccuggucaccuggcgaccugcuacagcuucgcgucggcuucgcgaugaugugcaga

TABLE 4-continued

Genes up-regulated in HF stem cells. Numbers in parentheses are the fold increase as determined by quantitative real time PCR.

| Gene Name/ Protein name/ GenBk Acces #. | Fold Incr. | Sequence | SEQ ID No. |
|---|---|---|---|
| | | gcaucaacuggcugcgggauggggugcagcugguggagagcaaccguacccgcaucacaggggaggagguggaggugcggg<br>acuccauccccgcugacucuggccucuacgcuugcgugaccagcagccccucuggcagcgauaccaccuacuucuccgucaa<br>ugucucagaugcacucccauccucggaagaugaugacgacgacgaugacuccuccucggaggagaaagagacggacaacacca<br>aaccaaaccguaggccuguagucccuacuggacaucccagagaaaauggagaagaaacugcaugcggugcccgcugccaag<br>acggugaaguucaagugcccgucgagugggacacccaaccccacucugcgcugguugaaaaauggcaaagaguuuaagccug<br>accaccgaauuggaggcuacaagguucgcuaugccaccuggagcaucaauaauggauucugugguugccuucugacaagggcaa<br>cuacaccugcaucguggagaauaguauggggagcaucaaccaccuaccaccuaccguugacgucugggaacgaucuccgcaccga<br>cccauccuucaggcagggcugccugccaacgagacaguggcccugggcagcaaguggaguucauguguaaggguguacagcg<br>auccgcagccucacauucaguggcugaagcacaucgaggugaacgggaguaagaucgggccagacaacuugccguaugucca<br>gauccugaagacugcuggaguuaauaccaccgacaaggaaauggaggugcuucaucuacggaaugucuccuuugaggaugc<br>gggggaguauacgugcuuggcgggaaacucuaucggacucucccaucacucugcaugguugaccguucuggaagcccugga<br>agagagaccagcugugaugaccucaccgcucuaccuggagacauuaucuacucgcaccggggccuuccugaucuccugcaug<br>uugggcucugucaucaucuauaagaugaagagcggccaccaagaagagcgacuuccauagccagauggcgugcacaagcugg<br>ccaagagcaucccucucgcgcagacagguaacaguguccagcugacuccagugcauccaugaacucuggggguucuccugguucg<br>gcccucacggcucuccuccagcggggaccccaugccggcuggagucuccgaauaugagcucccugaggauccccgcugggag<br>cugccacgagacagacuggucuuaggcaaaccacuuggcgagggcugcuucgggcaggugguguuggcugaggccaucggg<br>cuggauaaggacaaaacccaaccgugugaccaaaguggccggaggauggccaggaagguugaaguccgacgcaacggagaaggacccugucgg<br>aucugaucucggagaugaugaugaugaaaaugauugggaagcacaagaauaucaucaaccuucgggagcgugcacacagga<br>ugguccucuuuaugucauuguggaguacgccuccaaaggcaaccuccggggaguaucuacaggcccggaggccuccuggggcu<br>ggaguacugcuauaaccccagccacaaccccgaggaacagcugucuuccaaagaucugguauccugugccuaucagguggcu<br>cggggcauggaguaucuugccucuaagaaguguauacaccgagaccuggcugcuaggaacguccugguugaccgaggauaac<br>guaaugaagaucgcagacuuuggccuuagcucgagacaauucaucauaaucgacuacuacaagaaaaccaacggccggcugcc<br>ugugaaguggauggccccugaggcguuguuugaccggaucuacacacaccagagcgaugugugggucuuuuggagugcucuu<br>gugggagaucuucacucuggugcgucuccauaccccggugugcccuguggaggaacuuuucaagcugcugaaggaggguca<br>ucgaauggacaagcccaguaacuguaccaaugagcuguacaugaugaugcgggacgucuggcaugcagugcccucucagaga<br>ccuacguucaagcaguugguggaagaccuggaccgcauuguggccuugaccuccagccaggaguaucuggaccugugccauac<br>cgcuggaccaguacucacccagcuuucccgacacacggagcuccaccugcuccucaggggaggacucugucuucucucauga<br>gccguuaccugaggagcccugucugccucgacaccccacccagcuugccaacaguggacucaaacggcgcuga | |
| Fgf1/<br>Fibroblast<br>growth<br>factor 1<br>M30641 | 10 | auggcugaaggggagaucacaaccuucgcagcccugaccgagagguucaa<br>ccugccucuaggaaacuacaaaaagcccaaacugcucuacugcagcaacg<br>ggggccacuucuugaggauccucuuccugauggcaccgugggaugggacaag<br>ggacaggagcgaccagcacauucagcugcagcucagugcggaaagugcgg<br>gcgaagguguauauaaagggguacggagaccggccaguacuuggccaugga<br>caccgaagggcuuuuauacggcucgcagacaccaaaugaggaaugucugu<br>uccuggaaaggcuggaagaaaaccauuauaacacuuacaccuccaagaag<br>caugcggagaagaacuggguuuuguggggccucaagaagaacgggagcugua<br>agcgcgguccucggacucacuauggccagaaagccaucuuguuucugcc<br>ccucccggugucuucugacuag | 244 |
| Gpr49/<br>G protein-<br>coupled<br>receptor 49<br>FEX<br>AF110818 | 64 (377) | Sequence below. | 245 |
| | | auggacaccuccugcguccacaugcuccuguccuugcuggcgcugcugcaguugguggccgccggcagcucaccgggaccag<br>augcgauaccgcggggcugccaucacacugucacugugagcuggagcaggaugcgugcagguggacugcucggacc<br>uggggcucucggagcugccuccaaccucagcgucuucaccuccuaccuggaccucaguaugaacaacaucagucagcuacc<br>cgccagucuccuacaucgcucucugcuuccuagaagaguuacgucuugcuggaaaugcuuugacacacauuccccaagggagcg<br>uucacgggccuucagagccucaaagugcuuaugcugcagaacaaccagcugagaaagguuccggaggaagcgcuacagaauu<br>ugagaagccuucaaucccugcgccuagaugccaaccacaucagcuacgugccacccagcuguuucagcggccugcacucccug<br>aggcaccugugguagaugacaaugcucucacagacgcuccugccuggcuuucagaaguuuaucagccccugcaagccauga<br>ccuuggcccugaacaaaauacaccacauagcagacuacgccuuuggaaaccucuccagccucuggguucugcaucuccauau<br>aauagaauccacucccugggaaagaaaugcuuugauggacuccacagccuggagacuuugauuuaaauuauaauaaccuug<br>augaauccccacucgcaaucaagacacucuccaaccuuaaggaacuaggauuccacagcaacaacaucaggucaauaccggag<br>cgagcguucguaggcaacccuucucuuaucacaauacacuucuaugacaaccccauccaauuuguuggaguaucugcuuuuc<br>agcauuugccugaacuaagaacacugacuuugaauggugccucgcacauuacugaauuuccucacuugacaggaacugccac<br>ccuggagagucugcauuuaacuggagcaaagaucucaucucuuccccaggccgucuguugaucaguuacuaaaccucaagug<br>cuagauuugucuuacaaccuacucgaagacuuacccaguuugucaggcugcaaaaacuucagaaaauugaccugaggcaua<br>acgagaucuaugaaauuaagggcagcacuuuucagcaguguuuaacuccgaucucugaacuuagcauggaauaaaauugc<br>uaucauucaccccaagcguuuucuacguugccgucucuaauaaaguugaccuaucauccaaucuccugucguccuucccu<br>gugacugggauuacauggguuuaacucacuuaaaauuuaaacagggaaccgagccuuacagagccuguauaccaucugcaaacuccc<br>cagagcucaagauuauagaaaugccaucuguuacaucagcuccaauugggggugggagaaugcucauauauaaaaauuucua<br>accaauggaauaaagacgacgcaacagugугacgaccuucauaagaaaaugacgcugggguuauuucaaguucaagaugagcg<br>ggaccuugaagauuccuacugacuuugaggaagaccugaaugcccucacucggugcagugcucgccuucccagguccc<br>uucaagcccugugagcaccuauuugguagcuggcugauccgaaucggggugggaccacggcaguacugacgcuuuccgc<br>aaugccuuggugcuuugaccguucagaacuccccuguacaucucuuccauaaagcugcuaauugggguaucgcggua<br>guggacauucucaugggggucuccagugcugugcuggcugccguggagugcauucacuuuuggccguuugcucagcacgg | |

TABLE 4-continued

Genes up-regulated in HF stem cells. Numbers in parentheses are the fold increase as determined by quantitative real time PCR.

| Gene Name/<br>Protein name/<br>GenBk Acces #. | Fold<br>Incr. | Sequence | SEQ ID No. |
|---|---|---|---|
| | | ugcguggugggaagacggaaucggcugccaaaucguuggcuuccuguccauuuuugcuuccgaaucgucgaucuuccugcu<br>cacucuggcagcgcuggaacgaggguuuuucgucaagugcucuucgaaguuugaagugaaagcuccccuuuuuagccugag<br>agcgaucguuuugcuaugugucccguuuggcccugaccauugccacaaucccuugcuaggaggcaguaaguacaaugccuc<br>uccccucucugccugcccuugcccuuggggagcccagcaccacgggcuacaugguggcucucguguugcucaacucucucug<br>uuuccucauaaugaccauugccuacacaaagcucuacugcaguuuggagaaaggagagcuggagaaucuuugggauuguuc<br>gauggugaagcacauugcucuguugcucuucgccaacugcaaccuuuacugccccguggcuuucuuauccuucuccucuuu<br>gcuaaaccucaccuuuaucaguccugacgucauuaaauuuauacuuucucgugaucgucccacuuccuuccugucucaaccca<br>cuucucuacauugucuucaaucccauuuuaaggaggauaugggcagccugggaaagcauacccguuucggaugagauca<br>aaacacgcgagucugcuguccauuaacucggacgauguugagaaacggguccugugagucaacccaagccuuaguauccuuua<br>cccacgccagcauagccuaugacuugccuuccacuuccgggggcaucaccagcuuaccccaugacugaaagcugucaucucuc<br>uucaguugcauuugucccaugucucuagugacuaugagagaggaacguuuuuaagaguuggaaaccugaaaagugauuucu<br>aucagagcaguagcuaagaaaagcugagcuaaaaaccuaccuuaaaaccccaagcaaacaucucuaaauuggugugggaaacagu<br>ggugccuuagagcaggagagcaucauuaaacaccgccuuguaucauuuguucagcuaagaaggaaagccaucaagucacuuag<br>gugaacccagaugagaaaagcagccugaaaugcucuucgcauuguagucucuucugacucaccagcauagucucccauagug<br>agaagacucguuggaugacucaaugggguguauuuaaauccacaaauuccuuguuuaaaaggguuagaguuuuaagaaaaaaaa<br>aaaaaaaaa | |
| Igfbp5/<br>insulin-like<br>growth<br>factor<br>binding<br>protein 5<br>L12447 | 37 | Sequence below. | 246 |
| | | uuuuuuuucuucaccuccucccuuuucaaggccuccaagcuaauuauuucguugcuuuggagugagcaauucguggu<br>cucuccaccaccaccccaauucgacccgauccccgccuggggguuucuacggcucccgcucacucugcgugcaccuggcgc<br>gccucuuuuuucaccccccaaccuguugcaagucuuuaaucccuucaauuggaucuugcuggcaggcaccugaauccuccu<br>ugccucauauuugcaaguguuuggggggagagcaccugcucuaccugcaagagauuuaaaaggaaaaaaaucuccaggcucc<br>cucuuuucuccacacacucucgcucuccugccccgccccgagguaaagccagacuccgagaaaauggugaucagcguggccu<br>ccugcugcuggccgccuaugccguaccggcucaaggccugggugucuuucguugcauuguugaaccccugcgacgagaaagcucu<br>guccaugugucccccccagcccucugggcugugagcuggucaaagagcccggcugcgucugcaugacuugcgcccuggc<br>ggagggacagucguguggugucuacacagagcgcugcgcccaggguuugcgcugcuccccccggcaggaugaggagaagcc<br>gcugcacgcccugcugcacggccgcggggguuugccucaacgaaaagagcuacggcgagcaaaccaagauagagagagacucu<br>cgggaacacgaggaaaccccaccaccuccgagauggcugaagagaccuacucccccaaggucuuccggcccaagcacacucgcau<br>uuccgagcugaaggcugaggcuguguaagaaggaccgcagaaagaagaccccagucaagcaaguuugugggggugcagagaac<br>acugccaccccagagucauccccugccaccugagaugagacaggaauccgaacaaggccccugccgcagacacauggaagcuuc<br>ccuccaggaguucaaagccagcccacgcauggugccccguguguguaccucgccaacugugaccgcaaaggauucuacaag<br>agaaagcaguguaagccccuccgguggccgcaaacgugggcaucugcugguguguggacaaguacggaaugaagcugccgggca<br>uggaguacguggauggggacuuucagugcaacgccuucgacgaguaacguugacaguaaccucgccccccucccuuccuccccc<br>uauccuaccccccccagccccaacuccagccagcgccucccuccaccccaggacgucacauuucaucauuuaggggaaau<br>auauauacauauauauuugaggaaacugaggaccucggaaucucuagcaaggguaaggagacacuccccaccaugacccg<br>gaaaauguauuccuuuuugaagcaaguugaacggacagagaagggaaggaggagaagaagcaaggggagcgagagauggaaag<br>aaagcaaagcguuggaauagaggaaaagagggaaaggacagaauagagauugagagauagagaagaaacagcaaggcagaaagga<br>cuccacaaccaaggcugaaucugcccuuuugcuuucagcucuagcuggggucagaaaaagugggcauucagugacaccca<br>guuuagauuggucaagggggaaaagaaacaaggugugucagugccucucggucugucccuccccugcagccagcagugug<br>gauggcuagaccccucaccuccucucucucuuuacccaagugcagggugauuucauccccaaauuuacaaagacuaaaaugcau<br>uccaucccucugaaaauaaacaaaagugagugaauugaaguaagguuuuccccagcagacaagugaaccucagaauguguga<br>aauuuuacucuuguuaaagauuuuuuuaaggaugcaguacgcaccccccaacacuggaaagacuugauuucucagggugacaa<br>gcaauucagaagcgcguggcuucggcccuugauuucacuagacucaaagcuggcccggcagccucuguggaggaggaugag<br>agguggagaaaaccaagggcuuguacucacccacaagacuccauguagacuuuauaggcauauaaaucuauuuucuuuacc<br>uuuuuuucccuuucccuuucuuucgaaguuuugcauuaccucuuuuaaaguaguuuuuuuuaggcacugaagaucuuccu<br>cauucugggaaaauccauauuucacaaauacaacccagaacgccagcuuggccugcgucuggcagcaagcuuucucgugagcu<br>acaagugugcucuuuugugggggcaccgauuuggaucuucaaugauucaaacgugguguugaagugaauccaccaagcca<br>gguaacugccagcacccaagggugcaucaagugcauagcccaggucacccccauuucagccuuccaacccgcagaaaaguaacug<br>ucucacaccacaccacauaaaccugccagauccaucuguaacccacuggccugcccagaccuuuuuuucccaucugcauuuuu<br>uuuuuugaacugcauuuugaaagccuccccucagaugccaggcugacagaacagagagaacuaacaugagagagcagagg<br>aggaggaaguggaggugggggcagagacuucacagagagacauagaagauggacagaggucuggggguggggaggaca<br>agaaaagacagagagaggaaaauaccaauagaauuuuccuuggugucucccaucuaaucaacucucugagauuugagagga<br>aaaagaaggcaggggaagaacuugaggguagaaaugaggucaguucaagucacagggcccagauggugggguaacugaggcagg<br>auccagacuugagacacacgguuggaaacaaggcugguacccugacugggguauugaaggggugaagaggaugccuuggaaa<br>gacagcacaacuucaguucaacuucaggccccaaggaggaacugaggccaaagaauccuucaagugcuucaugagucuccuc<br>ugcccgacucaaacauccuucccgugaugaggauggauagaaagcccaggacaacucaggcccggaucuucacgacuguug<br>ucauuugccagccugauuuugauccaagagaagcaucucauugcccacuggcuucuucaacaaagagguggucuuaacaaaagg<br>cucaggacuaucuuugaagacugaagauaaccuuccaggagggagccacugguacaggaggcccuuuuggcgg<br>gggacagcucuuugcgcucucuugauggcauggcauaguagaggccccuccaacccggaacauggcaacaacaaaggg<br>agagcaaagaaacugacgugcgucgacucauaggcauggggcugcgggcacagaaagggaugccuccuguugccuggac<br>aggacaguuggcugggaaggaaagagaaauuugaucuucauaagacaaagggccugaugggauggcaauagaaggacuuacc<br>agccugcagggucaguauaucccaucaccccgcacaacauccccagccccccaacucaaacuucaaauauaauucuuaggccaguau<br>ccuagaccuagucucuucuucugccauuauuucccgcaucuggacaguacaucacugacaguuuccaagugauac<br>uggggguaccacugccccccaagaaaagacugagccaggaacugccuacucgcucccccuccccgagccuggagcuaacucccugu<br>gagggggugcucucuucacccccacaacuuacuagaccuugagugaccucugucccuuauguggggcucuucgcugugagcca<br>cagauggaggucauugauauagacaguuuagccuucccccaggucagccuaccucccccaaacuugugagucucccccgcugcuca<br>uauggagaggcaugucuaagacagcaagucuuucuagaggaagcuugccuuuaacagacagauggaacuaaaccuuccaaaug |

TABLE 4-continued

Genes up-regulated in HF stem cells. Numbers in parentheses are the fold increase as determined by quantitative real time PCR.

| Gene Name/ Protein name/ GenBk Acces #. | Fold Incr. | Sequence | SEQ ID No. |
|---|---|---|---|
| | | ggagaucuggcugaacccaggaucagagaccauggacauggaugggggucaucaagagaagagggaugccuuccuccagguu agggagagagaaggcaaguuugcaacgaucccaucaugcccugagcaagaagcuuuuggcccaggcuagccuuuaacuccau uagaggccucucuguugggguuuauccacagcaguaggcccaaguauggccugucccaccucuacuaucccgugaagguu ucuucccacccuuuugacaaaugccucacucgagcagugaaagauagcucucuuccccucuucugccagguaacaaag agaccuaaccaggaccuauucuccacccagccagucuugaccagccagaacaaagcagggaaccuggagaauaaaagacucu acguucucugacaaagacuuacguuucucugacggcagggccuaaacagacaaggcuuugaacaucugccccacaggau acggaggaggucagcugugcucacucccucuucuccuuccaagacccucuuccgaccaugacuuaucuccaugguaacauccu caccaucauucucccacuaccaagggguugccauggcaaccucccaaccaccugcccauccaggcaggcagcugaccuucgc ucagaacccuagaggacucuaggugaaauuuuacagcuuaagagaggagugagccaaggagaagagaccccuguaguccucug gcuuucaagagaaagaaggcuaugauuuaaaacacaguagaagggaaagaaggcucgcaggucgaccucuccccggggagc uuagggguuugacugucuuuauuuuuuuaaccacuaaagugcaaunuuuccugcacucuuguuaccccgccucucuucccu guuagguuucauuccuugagcagacuuucuuggguuuuuaauggaguauagacuuucaccacuucacagacucuggccu ccucuccaagucucucuggaugggaaaaggaaggguagagggucagagggggaaggguccccugucaccccgcauccauuca cccccacuucucugguccuagucaccggcuucacccccnaucuccgacaccaacaguagcacaguagcgcugucacacggau aguacaguucagacaagacuccuucagauuccgagacgccuaccgguuguuuuugguuuuguuuuuguuuuucuuuuguuu guuuguuuguuuuuacaacagcaauaaccacaucacauauuacuguagcucucuauaguguuacguucagacaccg uagcucuguccucucuauuuuguuggguuuugacuuaaaaaaaaaauacuuaugcuuuuuacguacaaacagauugaaaaa aaaauugaacaacaaaccaguuugugaaaaaaaaaaaaugugaaaaaaaaucacccccgauguggaagagcucggcuccucu uuagcauuuuguacuuaaggaaauaaaaaaagaaaaaccuggaagaucucacauuuauuacaaagugaaaaaaaaa | |
| Myoc/ trabecular meshwork induced gluco- corticoid protein AF041335 | 111 | Sequence below. | 247 |
| | | guccagucugcagucuguauucggaagacauagauacuaaauacauggcaacucuuuuuuugguuuguuuuaauucaucag gaugugagcgcuagucugggguaggagagccagucacccugaggacagcugaaacaaucgcuggcaaguauggagugugga ugagagaccccaagcccacccaccccuacacccaggaaagcacauggaggauugacacgguuggcacagagauccgccaggug uuugaguacagucagauaagccaguucgagcagggcuauccuuccaaggucccugugcucccucgggcacuggagagcacgg gugcugugguguaucggggagccucuauuuccagggggcugagucccagaacugugucagguaugagcuagacacggaga ccgugaaggcagagaaggaaaauccuggagcuggcuaccacggacucuucccguacgcgugggguggcuacacagacauuga cuuagcugggaugagagcggccucgggucaucuacagcacgcggaggaagccaaggggggcauagucccucuccaaauugaac ccagcgaaccuggaacuugagcguaccugggagacuaacauccguaagcagucuguggcaaugccuuuguuaucuguggca ucuuguacacgugagcagcuacucuucagcccaugcaaccgucaacuucgccuacgacacuaaaacggggaccaguaagacc cugaccauccauucacgaaucgcuacaaguacagcaguaugauugacuacaacccccuggagaggaagcuguuugccuggg acaacuucaacaugucaccuaugauaucaagcucuuggagaugugaggagccucuaaugccuaccagcaaaggccagaaaag gugaaguuccgggcucccgggugaagcagcugucagcagaggcagccagaugcauggaguuucuccuccugcuaaagauuu uguuuauccgggucaauguacagcuagcucccccucugacugacacgucccucaggcuuguauagucgcauagacucuguuc ucuucgucagcuuucaaagggcuguuccucuuuuaaaaaaucacauagug | |
| Itm2a/E25 putative Integral membrane protein 2A L38971 | 30 | Sequence below. | 248 |
| | | gggagaccugagcucgcugcugccugugaagacugggagaggagacacuaagugcugcucaagcaagcgcgauccucuccu cuuucaaccugcagcccaagaucacugauucgagccgcgccuuaccgcgcagcccgaagauucaccauggugaagaucgccuu caacaccccuacggcggugcaaaaggaggaggcgcggcaagauauagaggcgcucgucagucgcacugaccgagcucaaauc cugacacuggcaaggagcucagaguugcccgcaggagaaagauggcucaucgggagaugcaugcuuacucuccuaggccuc ucauucaucuuggcaggacugauuguggugagccugcaauuuacaaguacuuacaugcccaagagcaccauuuaccauggu gagaugcgcucuuugauucugaggauccugucaauucauucuucggaggagagccauacuuucugccugugacugaggag gcugauauccgugaggaugacaacauugccaucauuguaugccugugcccaguuucucugauagcgauccggcggcaauu auucacgacuuugaaagggaaugacugcuuaccuggacuugcuuugggaaacuguuaucugaugccccucaauacuucc auuguuaugacuccaaagaaucuggguggaacuuuuuggaaaacuggcaaguggcaaguauuugccucauacuuaugugguu cgugaagaccuggcugugugaagaaauucgugauguuaguaaccuugguauuuuuauuuaccaacuuugcaacaaccga aaauccuuccgccuuagacgcagagccuucucgcugguuucaacaagcugucaugacaaaugcuggaagauuagacacu uccccaaugaauuuaucguugaaaccaagaucugucaggaguagaaaugugacagauaaagaguauccuugauaauaagaagu caggaacuuaccgcucgacuuggaaaauugaaauugauggggauacucaugcuauuuacucauacauuuuacucuauugcuua uacuggaaaggaaagggaaggggggagaaaacuacuaaccacugcaagcgauuguccaauucuacuuuaauugacauugc uugcuguuucaacaagucaaaugaauaaucuuuucucuugaauuuuauaggguuuagauuucugaaagcagcaugaauggug ucaucuuaccaaccugacaauaaagcccaucccucugggnunuucaacaagcuuccaacacaucuuggccuagagcau gcuuaaauuuaaaauauuugaaauuguuuuuugacauuuuuuguguaaacauugcaaaucucuuuaccauucuuuggu uuucuucuuuauuauguucaacucuccugauuucagaaguucauuuugcauuucuaucaggugcuguguaacgaaucu gacugauaugugaacaaucuucaugaggaagcaauuuuuuacucauguaaugauucuuucucacugauaucuguauugua aauccacagaacuguacagguggcugaaugcuguaaggaguucggguugauugaauucuacaacccuauaauaaaguuuaccg uauucaauca | |

TABLE 4-continued

Genes up-regulated in HF stem cells. Numbers in parentheses are the fold increase as determined by quantitative real time PCR.

| Gene Name/ Protein name/ GenBk Acces #. | Fold Incr. | Sequence | SEQ ID No. |
|---|---|---|---|
| Eps8/ epidermal growth factor receptor pathway substrate 8 L21671 | 15 | Sequence below. | 249 | ggccauuaccaaucgcgacccgcgcacacacggcccgggcggcgggcgaagcgggcuccgggggcgcugggcgcagggcgcg
gggcaagccccagcagcgugucugcaacggggcgcggcgggcgcuccagcuccgggaucuuucuccccucggucacucucccuc
gcgcucuagggaggucguggcacucccugaggagcgcggcugcucggaggggcggauccuagaacagaggcgugagagccggc
augaauggucauaugucuaaccgcuccagugggguauggagucuacccuucucaacugaaugguuacggaucuucaccacccu
auuccagauggacagagaacacagcucaagaacaaggcaaaggcccuuuaugaacaaaggaagaacuaugcccgagacagu
gucagcagugugucggacguguccccaguaccgcguggaacacuugaccaccuucgugcuggaucggaaagaugcaaugauca
cugucgaggacggaauaagaaagcugaaguugcuggaugccaagggcaaagugguggacucaagauaugauucuccaagugg
augaccgagcugugagccugauugacuuagagucaaagaaugaauuggagaauuuuccucuaaacacaaucucgcauuguca
agcagugugcaaugcaugcugcuaugacucccauucucgccuuggugaagagccaacgcagagccaagccagaccuucac
cuuuuccagugugaugagguuaaggcaaaccuaauuagugaagauauucgaaauugcaaucaugucaguaaaggugggaaac
agaagaggcggccggaggcccugaggaugauugcaaagcagauccuggcaucccuccuccucccagagcuccugcccugu
gccaccggggacugucacacaggugggacguuaggagucgcguagcagccuggucugccugggcagcugaccagggugacuu
cgagaagccccggcaguaccacgagcaagaagagacgcccgagaugauggcgcccggaucgacagggaugugcaaaucuuaa
accauauuuuggaugacauugaauuuuuauaccaccaaaucccaaaaagccgccgaagcguuuucugagcuuucuaaaaggaa
gaaaaguaagaaaaguaaaaggaaaggaccuggagagggcguuuaaacacugagggcaaaaccgccaccuccugacgaguuu
guugacuguuuccagaaguuuaaacaugaguucaaccuucuggcaaguuaagucccauuccagaacccgagugcuucag
aucuggucauuuuguuuuacuccacuaaauauggugguccaggcaacaggugggccugaacuggccaguucgguacuca
gcccacugugacaaagacacaguuugauuucuuaaacuacacaagccacugcggaagcggaagcugguggaugucacuggg
agauaguuggguaagugagagcagagugggccgaaagaacaguucaucccaccuuacgucccgagguuccgcaacggcugg
gagcccccgaugcugaacuucaugggcgcgcccacagagcaagacaugauaucaacuggccgagucccguggccaacgcagaaca
ccagcgcaaacaggacagcaagaggcugucacagagcauuccaaugugcccgacuauccuccagccgacggauaugcguaca
guagcagcauguaccacagaggaccacaugccagaccacggggaggcgccaugccuuucaagucaacuccuaaucaccaagua
gauaggaauuaugacgcagucaaaacacaacccaagaaauacgccaaauccaaguacgacuuugugggcgaggaacaccagcga
gcucucgguuaugaaagaugaugucuuagagauacucgacgaucgaaggcaguggugaaagccggaaugccaguggaga
cucugggguuugugccaaauaacauucuggauaucaugagaacuccagaaucuggaguggggcgcgcugacccccauacaca
cauaccauacagaaacaaaggacggaauacggccugagaucagcugacacuccuuucugccccaucacccccuccaagccagca
cccguuccggucccccuuccaccuucuguaccagcacccguuucugugcccaagguucagcagaugucacccgccagaaca
gcagcuccagugacaguggggcagcauugugcgggacagccagagaucaaacaacuccagguggaccgaaggaaguccca
gauggaagaggguucaggaugagcucuuccagaggcugaccaucgggcgcagugcugcgcagaggaaguuccacgugccacg
gcagaacguuccagugaucaauacacuuaugacuccucaccggaagaaguaaagcuggcugcagucaaagggauucaau
cccgugacugucaauagccucggggugaacggagcacaacucuuuucucaacaaagacgaacugaggucugucugcc
cggaaggugccagagucuuaaccaaaucacuguucagaaagcugcuuuggaggacaguaauggaagcuccgaguuacaaga
gaucaugcggagacggcaggagaagaucagcgccgcugcgagcgacucgggagguggagucuuuugaugaagggagcagcca
cugaguccaugaacuuccuuaauucuuggguguugucguugaacaguguggcaugcuuugguuuaagaagccuugaaggg
aaugucaaagcugucgucuugguauaauguaauuuaucgccauauaaggaaacaguauaugccugaguaagcagaggacccgc
ugcuucugugcacauuaguuugauuaaaaacugagaagcgggguagguguagaauggcucagcaaguaaaggugcuugcugccaa
gcccaaugacccaaguucgaguccccuggggucuacauugguaggagagagcuggcuucugcaaguugccucugaccaccacac
auaaauaaaacaaaugaauuuaacaaacuuuuaaaagaaauuauuuaaaaaccagacguucugacuguucugggc
uugggaaauauuuuuuucacuuuccuaagguguacuuuccuuugcuacauuaauuauugcgccuuguucgaugaucuaa
guggggauauuugacaauggcagauuuauucauugcaacaaggaaagacacagccauugaugaaaaaaaaaagaaagucuca
gcuuucagucacugggauaccugcugccaggggaggaggcucaguuagacuaccccucugcuuacuugaggucugacaugcc
caaugagaguguauuuagcuuuauuuaaaaguucuuaaaugccaacaguuuuaaaaaucacauuuaaaaugaacuguacaaggu
agccagaccuugaauguaugaauagacuauauaauauguccccgagaaacuuuguuacucucagcucuguugauugcgaaauc
uugcauagauuaugcuuugauuuaguuucu

| Fyn/Fyn proto-oncogene M27266 | 10 | Sequence below. | 250 | ccugggccccgccgcggacgcgcggagccgccugggccgcgccggaggagggcggggagaggaccaugugaaugugcuccg
gagcugagcgccaagccaagcagugauugaaaggaacaggaugcugaucuaaucguggcaaaaagucaggucccgaccgcuggu
uucgaagacauguggguguauauaaaguuugugauaguugguggaaauugggagcuuggauaaugggcgugugcaaugu
aaggauaaagaagcagcgaaacugacagaggagagggacggcagccugaaccagagcucugggugaccgcuauggcacagaccc
caccccucagcacuaccccagcuucgcgcugaccuccaucccgaacuacaacaacuuccacgcagcugggggccagggacuca
ccgucuuuggggguguugaacuccuccucucacacugggaccccuacgcacgagagaggacaggagugacacuguuugug
cgcuuuaugacuauaagcacggacggaagaugaccugaguuuucacaaaggagaaaauuucaaauauugaacagcucgua
aggagauugguggaagcccgcuccuugacaaccggggaaacugguuacauuccagcaauuacguggcuccaguugacuccc
auccaggcagaagaguguacuuuggaaaacuuggccgcaaagaugcugagacagcuccugucccuuuggaaacccaagag
guaccuuucuuauccgcgagagccaaaccaccaaaggugcuacucacuucaccgugauugggauguauuuggga
ccacgucaaacauuauaaauccgcaagcuugacaaugguggauacuauaucaacaacgcggggcccaguuugaaacacuucagc
aacuggugacagcauuacucagagaagcugauggggugugguuuaacuuaacugugguuucaucaaguuguaccccacaaa
cuucuggauggcuaaagaugcuugggaaguugcacgugacucguuguuucggagaagaagcuggggcaggggguuuc
gcugaagugguggcuugguaccuggaauggaaauacaaaaguagccauaaagacccuuaagccaggcaccaugucuccggagu
ccuuccuggaggaggcgcagaucaugaagaagcugaagcaugacaagcugguugcagcucuacgcgguucgugucugaggagcc

TABLE 4-continued

Genes up-regulated in HF stem cells. Numbers in parentheses are the fold increase as determined by quantitative real time PCR.

| Gene Name/<br>Protein name/<br>GenBk Acces #. | Fold<br>Incr. | Sequence | SEQ ID No. |
|---|---|---|---| cauuuacaucgucacggaguacaugagcaaaggaaguuugcuugacuucuuaaaagauggugaaggaagagcucugaaguu
gccaaaccuuguggacauggcggcacagguugcugcaggaauggcuuacaucgagcgcaugaauuauauccacagagaucug
cgaucagcaaacauucuagugggaauggacuaauuugcaagauugcugacuuuggauuggcucgguugauugaagacaau
gaauacacagcaagacaaggugcgaaguuucccauuaaguggacagcccccgaagcggcccuguauggaagguucacaauca
agucugacguauggucuuuuggaaucuuacucacagagcugguccaaaggaagagugccauaccaggcaugaacaaccg
ggaggugcuggagcagguggagagaggcuauaggaugcccugcccacaggacugcccgaucucccugcacgagcucaugauc
cacugcuggaaaaggaaucggaagagcgcccgaccuucgaguacuugcagggcuuccuggaggacuacuuuacggccacag
agccccaguaucagcccggugaaaaccugugagagccugcgcuucagacgccucuucccgaggccucccuaccccuccccauu
agcuuccaauucuguagccagcugcccccagagcaggagaaccguccagguaucagauugcaugugacucuugaagcugaacuu
ccacggcccucauuaaugacacuugucccccaguccgaaccuccucugugaaccaucugagacagaagcguguuauuucuca
gacuuggaaaugcauuguaucgauguuaugucaaaggccaaaccucuguucaguguaaauagcugcuccugugccaacaauc
ccagugcuuccuuuuuaaaaagaaaaagcaaauccuaugugauuuuaacucugauuucaccugauucaacuaaaaaaaa
aaaaguauuauuuccaaaaguggccucuuugucuaaaacaauaaaauuuuuuucauguuuuaacaaaaaaaaaaaaaaa
aaaaaaa

Structurally-related

| Col6a1/<br>Procol-<br>lagen, type<br>VI, alpha 1<br>X66405 | 36 | Sequence below. | 251 |
|---|---|---|---| cccucccuggcucucuccucagcucugggcucugacugcagcaagcagagacaaccucucacucugccuuucccagcgcccac
ccugacccuggcccacauuugacggugacucgcaggccagccagaaacaugaggcuggcccacgcucugcugcccugcugc
uacaagccugcuggguggccacacaggacaucaggccauccucccaaagcgauugccuuccaagacugcccuguggaucuauucuu
cgugcucgacaccucggagagugugguccuugaggcugaaaaccuuauggggccuuggguggacaaggugaagucccuucacuaa
gcgcuucauugacaaccugagagacagguacuaccggugugaccgcaaccugguuuggaaugcgggugcgcugcacuacag
ugacgagguggagaucauccgagggcucacgcgcaugcccagugccgcgaugagcucaaggccagcguggaugcggucaag
uacuucgggaaaggcaccuacaccgacugcgccauuaagaaggggcuggaggagcugcucauaggggggucccccaccugaagg
agaacaaguacuugaucguggugaccgacgggcauccucuagagggcuacaaggaaccaugcgggggucuggaagaugcagu
aaaugaggccaaacaccugggcaucaaggucuuuucugguggccaucaccucgaccucgcucuggagccgacuggagauga
gccacagaccacacauaccggcgcaauuucacggcagcugacuggggggcauagccgcgaugcagaagaggucaucagccagac
cauugacaccauugugggacaugauuaaaaauaacguggaacaagugugouguuucuuugagugccaggcugccagaggacc
uccagggccccgaggcgacccugggguaugaggggagcgaggaaagccaggucuuccgggagagaagggagaagcuggagac
ccuggacgaccugggggaucuuggaccagucgggguaccagggguauaaaggggagaaagggagccguggagagaagggguucc
agaggaccgaaagguuacaagggcgagaaaggcaagcgcggaaucgacggggucgacggcaugaagggagagacgggguacc
caggacuaccgggcugcaagggcucccccaggauuugauggcauucaaggaccccgggucccaagggugaugcuggugccuu
ugggaugaagggagaaaagggguggaagcuggagcagacggugagcggcagggaacucaggguccaccggagauga
gggugauccuggagagccuggucccccggagaaaaaggagaggccggaugaagggaaaugcuggcccagacggugccccu
ggagagagggguggcccuggugaaagaggaccucgggggaccccuggugugagaggaccaagggggagcccgggugaagcu
ggaccacagggugaccaaggaagagagggccccgucggcaucccuggagacucggguaggcuggccccauuggaccuaaag
gauaccgaggugaugagggucucccaggccugagggccucagaggagcccaggaccuguuggucccuccuggagaccccgg
acugauggguagagagggugaggauggaccaccaggaaacgcacggaagguuucccggcuucccuggguuauccaggcaac
agaggcccuccugggcuaaauggcacaaaaggcuaccccuggccucaaggggugaugaggugaaguggggagacccaggagg
auaacaacgacauuucaccccgugggcuvcaaaggggcaaagggauaccgaggcccagaaggacccccaggaccuccaggacau
guggggaccaccuggccgaugagugugagauccuggauaucaucaugaaaaaugugcuccugcugugagugccacaugugga
cccauugacaucucuucgugcuggacagcucggagagcauuggccuacagaacuuugagauugccaaggacuucaucauca
aggucauugaccgguugagcaaggaugagcuggucaaauuugagcagggcagucucacgcgggcguguuacaguacagcc
acaaccagaugcaagagcacguggacaugcggagccccaacguccgcaacgcccaggacuucaaagaagcugucaagaagcua
caauggauggcuggugcacauucaccggagaagcgcugcaguacacccgggaccggcuacucccaccacacagaacaaccg
aauugcccuggucauuacggauggacguucugacacucaacgggacacgacaccucacagugugucugugggugcagacauu
cagguaguuucgugggaaucaaggaugguguuuuggcuauugucuccagcucaaugcauuucugccaaggc
uuaucgcaaggucguccagguauucuccugguaaggagaacuaugcagagcuucucgaugacggcuuucugaagaacauaa
cagcccagaucuguauagauaagaagguccggauuauaccuguccaaucacauucuccucccggcugacaucaccauccu
gcuagacagcucagccagugucggcagccacaacuucgaaaccaccaaggucuuucgccaagcgccuagcugagcgauuccug
ucagcaggcagggcggaucuucccaggaugugcggguggccguggauacaguauaguggcaggggcagcaacagccaggu
cgggcggcucuucaguucuuacagaauuacacagugcuggccagcucugaggacagcauggauuucaucaacgacgccacag
acgucaacgaugcucugagcuacugcuuucuaccgggaagccucgucagguccacacaagaagaggucucuuugu
uuucagacggcaacucuccaggggggccacagcgaggccauugaagcuggucgugaccgccccgugcugacacacaugau
cuuuguggguggugugggacccaggugaaccgaccccacauccgugcuugucacuggcaagacugcagaguacgacgu
ggccuuuggcgagcgccaccuauuccguguaccaaacuaccaggcccugcuacuggcguacucuaccagacagucuccagg
aaguggcacgggcuagagggccacacacguggcuggacacacauggcauggagacacauuucaacaggccuucccgcccu
ucccacugacaaaacaggaauaggaaaugugacccaacuggucaaucaacugucuuaaagggaacgcugagaugcacacucu
uugcuuuguguaaugucccccugugggcucaccugagcuccuaucuagaucccgccuuggvuuguacaucaugguggcauc
uugcugaccccuccccccaucugggacuggauccagccaucucgucuuccuvcucacugcccuaaccuauccguggugucuu
cacaccaucacugcaguuuccgucugguguucugucuuccaugcucaacaugaagcagaccuucucaugagvucagcuugcug

TABLE 4-continued

Genes up-regulated in HF stem cells. Numbers in parentheses are the fold increase as determined by quantitative real time PCR.

| Gene Name/ Protein name/ GenBk Acces #. | Fold Incr. | Sequence | SEQ ID No. |
|---|---|---|---|
| | | gauuauggcuuuuaggaaauugaacacaggaggaguuccaaacacaaacuuggaggagacccuccucuucaucaggugcuu gucagugaccuacaugcaucuuggucugguccuuaguggcuaguccuuccacucugaaagcaaaggugcuaucuaucugua aggggcucucucuacacacccagaggcuuagcuuggacaguucacacucaagugucccugucagaaucaauccagagcuuucuc ccucaaaauagugacuugucuccccugguccccaaaggcuccccuuuaguuaguuucuucauggcuccccacauuccccg uaaucugauccaagccagcuaucucugcuaauaaagguuuccauuuuucaaaaaaaaaaaaa | |
| Tnc/ Tenascin C AV230686 X56304 | 17 | accccaugccccacccccaccuucgauguuuugaacauuucuaacaacug aagccaguaaagucauauucuuuaaauuuccaggacauucauauuauuc acauaaaucauggucauggugaugauggaaacugaggacuuuaaaagaga uuuuccuucccaaacguuucuggacaguaccugauuguauuuuuuuug uuuuguuuuguuuuuuaauaaaagcacaguacuuuucc | 252 |
| Krt2-6a/ Keratin complex 2, basic, gene 6a (keratin 6a) K02108 | 10 | Sequence below. | 253 |
| | | gucugcccugccguuucucuacuuccccagccuucucaucuccaggaaccaugucuaccaaaaccaccaucaaaagucaaacca gccaccguggcuacagugccagcucagccagagugcuuggacucaaccgcucgggcuucagcagugugucgugugccgcuc ccggggcagcgguggcuccagugcaaugugugaggagcuggcuuuggcagcaggagccucuaugguguggggagcuccaa gaggaucuccaucggagggggcagcugugcauuggaggaggcuauggcagccgauucggaggaagcuucggcauuggugg uggagcugguaguggcuuuggcuucgguggugga gcuggcuuuggugguggcuaugggggagcuggcuucccggugugc ccacuuggaggcauccaagaggucaccaucaaccagagccuccucacaccccugaaacccuga caaauugacccccaccauccagcg ggucaggacugaggagagggagcagaucaagacccucaauaacaaguuugccuccuucaucgacaaggugcgguucauggag cagcagaacaaggucauggacaccaaguggcccugcugcaagagcaggacaccaagaccgugaggcagaacauggagcccau guuugagcaguacaucagcaacuccgcagacagcuggacagcaucauuggagagagggucgcaugaacucagagcugagg aacaugcaggaacucguagaagaacuacgaacaaauaugaagaugaaaucaacaagcgcacagacgcagagaaugaauucgu gacccugaagaaggauguagaugcugccuacaugaacaaaguugaacugcaagccaaggcagacagucuaacagaugauauc aacuucuugagagcucucuaugaagcagaacugucc agaugaugcaaacucacuucagaccaucugugguccucucccaugg ucaacaaccguagccucguccuagacagcaucaucgcugaggucaaggcccaguuuggaggucauagcucagagaagucggc ugaagcugagucauuguaccagacuaaauaugaggagcugcaggucacagcuggcagacaugggacgaccugcgcaacacc aagcaggagauugcugagaucaaccgcaugauccagaggcugagaucugagaucgaccacguuaagaagcagugugccaacc ugcaagcugcuauugcugaugcugagcaacgugggg agauggcccugaaggaugcaaggggcaagcuggaagggcuggagg augcccugcagaaggccaaacaggacauggccaugcugcugaaggaguaccaugaacucaugaaugucaagcuggcccuuga uguggaaauugccaccuacaggaagcugcuggaaggagaggagucagguugaauggugaaggguguuggaccagucaacau cucguggguacgcagccaccgugucccagccguauaggcagcgggcugccagcagcagcagcuuaaggcauggguggaggcag cagcuacuccuauagcagcagccauggccuuggaggugggcuucagugcuggcaguggcagaggccaucggaggugggcuucag cucuucggugggccucagcucuuucuaccaucaaauacaccaccaccuccucagcaagaagagcuacaggcagugaauucug ucaccaagagcuugucucugguccccagaugucauggcugcagcugaaccacaugcuuuggluucccggaagggaacgaaucc aaccucuggccucccccauggcucaguucuacauuugugugcacgucagcaccauacaugucuuuggugacccagacccc aaaauguugcagaauguagaccuccaagacgaaacccccaaacccucccagaauaccaccuaaauucgucaugguucugac uuccuccagagucuguaaauaaaaugccccccacaacaaac | |

Channel-related

| Potassium channel, subfamily K, member 2 AI849601 | 14 | uuuuuuuuuuuuuuugauuuuaauuacaaacuuuauuugcccuc caguucacaguuuauacgugguacaucccaccaugucagcuuccagaa cggcuauucaggagauggguggagcuuucuuugaaaggaacccgac auuuaaaauuuuggguuagaaucuucauaggguuuauaaaaguacucu cugcaagcgaacuggauauauuuuacauuuauagcuuuaaaucaaauu uuggaaaauaggaaucuuuuugugguuuuuaaaacauccugggulluuau gucuuaagacuuuacucucgaaugccacaugaucacguaagcccaagcc uccccagaagggaaaaaucaguuuugc | 254 |
| Skd3/ Suppressor of K+ transport defect 3 AI837887 | 4 | uuuuuuuuuuuuuuuuugggugccaugccacagcaaggggccuuua uuagauguucagggcacagacagguggaugcuagaugguguagcaca ccuucucaggguggagugguglccuggaugucagulluugcgggucuu gcugucculaucaaugaucuccagucgcaauguagguggacgcuucu cagccuggggugagggcagcucacgcgcucuulugaggaglugcuugucc gaauccuccacagugalauacccagggugcaaccccccugg | 255 |
| Clic4/ Chloride intracellular | 3 | uuuuuuuuuuuuuucugacacaguaguaauccuuccagacuccuua cacaauauuacaaccccccaguacauaaauguuccuauaccaugcaca cagcaacauggggguccacugaugucgcaggcgacuuuucuaaugguq | 256 |

TABLE 4-continued

Genes up-regulated in HF stem cells. Numbers in parentheses are the fold increase as determined by quantitative real time PCR.

| Gene Name/<br>Protein name/<br>GenBk Acces #. | Fold<br>Incr. | Sequence | SEQ ID No. |
| --- | --- | --- | --- |
| channel 4<br>(mito-<br>chondrial)<br>AI845237 | | gaacauagcaccucaaguucugccaucuacacagugaagggacgugau<br>ggucggggcuccagagugacagcaaacugccucuuggggugacacgcu<br>uguggcgaagugccucc | |
| Col18a1/<br>Endostatin<br>(alpha<br>1(XVIII)<br>collagen)<br>L22545 | 5 | Sequence below. | 257 | gagaauguugcugaggaggugggcugcugcagcuccuuggagacccccuaccugagaagaucucacaaaucgaugaccuc
acgucgggccggccuacaucuuuggaccagacuccaacaguggccagguggcccaguaucauuucccaaaacucuucuuccg
ggacuuuucgcugcuguuucaugucuccggccagccacagaggcagcaggggugcuauuugccaucacagaugcugcccaggu
gguagucucacugggcgugaagcucucagagguccgagauggacagcaaaacaucucauugcucuacacggagccugggggcc
agccagacccagacggggagccagcuuccgccuaccugcauuuguugggcaguggacacacuucgcgcucagcgucgacggag
gcucuguggcucucuacguagacuguaagaaauuccagagggugccauuugcucgggccucgcagggacuggagcuagagc
guggcgcuggccucuuugugggucaggcuggaacagcagacccugacaaguuccaggggaugaucucagagcugaagguac
gcaaaaccccccgggugagcccugugcacugucuggaugaagaagaugaugaugaagaccgggcaucuggagauuuuggaag
uggcuuugaagaaagcagcaagucacacaaggaggauacaucucuacuaccuggggcucccucagccaccuccugucacuucc
ccaccccuggcuggaggcagcaccacagaagaucuagaacagaagaaacggaggaagacgccgcggguagauuucuauaggagc
ugagaccccuuccuggcacagguucaagcggugcauggguaggucuauccagaaccccggaaggggcuugauaaagggagg
uaugaaggacaaaagggagaaccagguccccagggcccaccuggcccagcuggccccagggucgccgguccaguggu
cagagccccaacucacaacugucccuggagcacaaggaccccccgggaccucagggcgccaccagggaaggauggcacuccagg
aagggauggugaaccgggugaccucggugaagaugggagaccgggugacacuggaccucaaggcuuuccagggaccccagga
gaugugggcccuaagggcgagaaggggagauccugguauugggccccgaggaccuccagggccuccagggccaccaggacccu
ccuucagacaagacaagcugaccuucauugacauggagggauccgguuucagcgagacauagagagccuuagaggcccacg
aggcuucccuggccccccggggccccuggugucccaggacuuccuggugagccaggacgcuuugggaucaauggguuccua
ugcaccaggaccugcaggccuuccuggugcuaccuggggaaggaaggaccccccgguuuccaggucccccgggaccuccaggu
ccuccaggcaaagagggccaccaggaguggccggccagaaaggcaguguugugaugugggcaucccagggacccaaggggga
gcaaaggagaccuuggggccaucgguaugccuggcaagucuggcuuggcuggaucccucgggccaguuggaccccccaggacc
uccaggggcuccagggccaccaggaccaggauuugcugcuggauucgaugauauggaaggcucuggaauacccucugg aca
acagcccgaagcucugaugggcugcagggaccucccgggucgccgggacucaaggggauccuggagugcaggccuaccug
gagccaaggagaaguuggagcagauggagccagggcaucccuggucccccaggaagagaaggugcagcuggaucuccggg
gccaaaaggagagaaggggaugccgggagaaaagggaaacccaggaaaagauggagugggccggccgggccucccugggccu
ccaggaccuccagggcuggugaucuaugugucaagugaggauaaagcaauagugagcacgccaggaccugagggcaagccag
gguacgcaggcuuccuggaccugcuggaccgaagggugaccuggguuccaaaggcgagcagggucuucggggguuuaagg
gugagaagggagagccaggcacuaucuuuaguccugauggcagacgucugggccaucccagaagggagccaagggagagcc
aggcuuucgaggaccccgggguccuuauggacgaccuggcgcacaagggugaaauuggcuuccuggacggccgggucgacc
uggaacgaauggcuuaaagggagagaagggagagccuggagaugccagccuuggguucagcaugagggauugccuggccc
cccugggccuccaggaccccaggccuccuggggaugcccaucuaugacaagcaaaggcauuugugagucuggccgaccugga
cuaccaggacagcaggggugugcaggccuucaggacaaagggugacaaggagaguggggccaccugggccaccaggc
aauuccccauugaccucuuccaccuggaagcggaaaugaaggggacaagggagaccgaggggaugcuggacagaaaggaga
gaggggagaaccuggggcuccuggguguggauucuucagcucaagaguaccuggcccacccggcccaccuggauacccugga
auuccggguccaaaggagagagcauccgggggccaccuggccuccuggccccagggaccuccuggcauuggcuaugagg
gucgccaggucccccaggaccuccaggaccuccaggaccucccuccuucccuggcccucacagacagacugucaguguccu
gguccuccgggccaccugguccuccaggucccccaggagccaugggugccucugcugggcaggugaggaucugggccacau
accagaccaugcuggacaagauccggggaggugccggagggcuggcucaucuuuuggccgagagggaagagcucuaugac
gcguuagaaaauggcuuccgaaggugcugcuggaggcccggacagccuccugagaggcacgggcaaugagguggucucuu
uccagccccccauuguccagcuucaugagggcagucacauacaccggagggaguaucccuauuccacggcacgacccuggcg
agcagaugacauccuggccaacccaccgcgccugcagaccgccagccuuacccuggaguuccaucaccacaguuccuaug
ugcaccugccgcagccccgccccacccucucacuugcuacauacucaucaggacuacuuucagcugucccaccugguggcacu
gaacaccccccugucuggaggcaugcguguauccguggagcagauuucagugcuuccagcaagcccgagccguggggcug
ucgggcaccuucccgggcuuucugucccucuaggcugcaggaucucuauagcaucgucgccgugcugaccggggucugug
cccaucgucaaccugaaggacgaggugcuaucucccagcugggacucccuguuucggcucccagggucaagugcaaccg
ggccccgcaucuuuucuuugacggcagagauguccugagacacccagccuggccgcagaagagcguauggcacggcucgga
ccccaguggcggaggcugauggagaguuacuguguagacauggcgaacugaaacuacuggggcuacaggucaggccucccc
cugcugucaggcaggcuccuggaacagaaagcugcgagcugccacaacagcuacaucguccugugcauugagaauagcuuca
ugaccucuuuccccaaauaggccucgccagcuagggguggcagacagaggccaugcagaacuuugacacagcgcaggagca
uucagucagcacccagggcucuggcugggauacaaucucucuguauaguuccauuuuuauguaauccucaagaauaaaagga
agccaaagaguaaaaaaaaa

TABLE 5

Genes down-regulated in HF stem cells.

| Gene Name/protein | Fold Decr | Sequence | SEQ ID No. |
|---|---|---|---|
| Growth Factors, Receptors and Downstream genes | | | |
| GNA-14 Mouse G protein alpha subunit (GNA-14) M80631 | 32 | Sequence below. | 258 | aacugccuucgagaagcguuagccuagagauccgagccucuucuccauaccauaguugguucagguggguuccucuucaaac
cuugcgucugcggauaauccgcgcggccgggcguuaagcuccaggucccugucgcuccgucgaggugcaagccauggccg
gcugcugcuguuugucugcggaggagaaagagucucagcgcaucagcgcggagaucgagcggcacguucgccgcgacaagaa
ggacgcgcgccgggagcucaagcugcuguugcugggaaccggugagaguggggaaaagcaccuuuaucaagcagaugaggau
aauccaugggucuggcuacaguguaugaagauagaaagggcuucacgaagcgguuuaccaaaacauauucacggccaugcaa
gccaugaucagagcaauggauacccugaggauacaauacaugugugagcagaauaaggaaaaugcccagaucaucagggaag
uggaaguagacaaggucacugcacucucuagagaccagguggcagccaucaagcagcuguggcuggaucccggaauccagga
guguuacgacaggaggagggaguaccagcugucagacucugccaaauauuaccgacggacauugagcguaucgccaugccc
ucuuucgugccaacacaacaggaugugucuucgguguuagagugcccaccacugcaucauagaauauccauucgaccuggaaa
acaucaucuuccgaaugguggauguugguggccagcgaucugaacgacggaaauggauucacugcuuugagagugucaccu
ccaucauuucuuggugcucugagugaauaugaccagguucuggcugagugugacaaugagaaccgcauggaggagagca
aagcccuguuuagaaccaucaucaccuaccccugguuucugaacuccuccgugauucuguucuuaaacaagaaggaucuucu
agaggagaaaaucauguacucucaucuaauuagcuaacuuccagaguacacaggaccaaagcaagaugucaaagcggccaggg
acuuuauccugaagcuguaucaagaccagaauccugacaaagagaagguuacuuauuccacuucacuugucuacagacac
cgagaauauccgcuuugguguuugcugcugucaaagacacaauccuacagcuaaaccuacgggaguucaacuuggguguaaaug
gagggccuacuccuccgagacagagggugaucugagcccuuccugccugaucuacaagugcuucuggaccaggaccuaagga
cauuauguagcccacaggacagagaugggguagugcaaugugaaaaauacuucaccaacccuuuuaaguguucuuuaauucuuc
acugucuaacucuuuucgccuuuugguugaacgauuagguaucauuuuugaguggguuccccucuccuauuuuuuuaa
acuaguguucaacaguuauuaaaaaaucaugc

| Ly6/Lymphocyte antigen 6 complex X04653 | 12 | gaauucccugcaaccuugucugagaggaagcaaggacuggugugagg
agggagcugugagguuuaucugugcagcccuucucugaggaugga
cacuucucacacuacaaaguccuguuugcugauucuucuuguggccc
uacuguguugcagaaagagcucagggacuggagugguaccaguccua
uggagucccauuugagacuucuugcccaucaauuaccugcccuacc
cugauggagucuguguuacucaggaggcagcaguuauugugggguuc
ucaaacaaggaaaguaaagaacaaucuuuugcuuacccaucugcccucc
uaauauugaaagguauggagauccugggguacuaaggucaaugugaaga
cuuccuguugccaggaagaccucugcaaugcagcaguuccaaugga
ggcagcaccuggaccauggcaggggugcuucuguucagccugagcuc
aguccuccugcagaccuugcucugauggucccuccaaugaccuccac
ccuugccuuuuauccucaugugcaacaauucuuccuggagcccucu
agugaugaauuaugaguuauagaagcuccaaggugggaguaguguug
ugaaauaccauguuuugccuuuuauagcccugcugggggauaggaggug
cucuaauccucucuagggcuuucaagucuguacuuccuagaauguca
uuuuguguggauugcugcucaugacccuggaggcacacagccagca
cagugaagaggcagaauuccaaggguauuaugcuaucaccauccacac
auaaguaucgggguccugcaaguguucccacauguauccugaaugu
ccccuguugagucccaauaaaaccccuuuuguucuccc | 259 |
| Bmp4/Bone morphogenetic protein 4 L47480 | 11 | Sequence below. | 260 | ggaagaaagagaggagggaaaagagaaggaaggaguagaugugagagggugggcugagggugggaaggcaagagcgcga
ggccuggccccggaagcuaggugaguucggcauccgagcugagagaccccagccuaagacgccugcgcugcaacccagccuga
guaucuggucuccgucccugagggauucucgucuaaaccgucuuuggagccugcagcgauccagucucuggcccucgacca
gguucauugcagcuuucuagaggucccccagaagcagcugcuggcgagcccgcuucugcaggaaccaauggugagcagggcaa
ccuggagaggggcgcuauucugaggaaucgaggugcaccgguguagaugaagcugggauggggcucaggcguguaaccgaggc
aaaaguggccuauuccuccuuccuucuccaacaguguuggaggguggaugauggaggcaaaaggcaccuccauauaugu
uacugcgucuaucaaccuacuuuagggaggugcgggccaggagaggcgggaaggagaaaggccuuggaagagaggucauu
gggaagaacugugggguuuggugggguuugcuuccacuuuagacuauaagaguggagaggagggagucaacucuaaguuuc
aacaccaguggggggacugaggacugcuucauuaggagagagaaccuagccagagcuagcuuuugcaaaagaggcuguagccuu
gcuuugcucuaaagcgcgacccggggauagagaggcuuccuugagcggggugucaccuaaucuuguccccaacgcacccccuc
ccagcccccugagagcuagcgaacuguaggacacaacucgucuccaacuccuccaggacgcuauuuuucuuuagacauggggcaccccau
gauucugccuucugguacucuccccuccccuggaaagggguguaagguuccgacggaaccguggccaggaugccgaaaggc
uaccugucgggucuucugccaugcugugucugugcggacaugccagcagggcuaaugaggagcuugcgauacuccaaagg
guucgggaauugcggggguccuuacacgcaguggaguugggcccuuuuacucagaagguuuccgccacggcuuuggguugau
aguuuuuuuaguauccugguuuaugaacugaaggguuuugugaugauuguugaaucacuagcaggguucauauuuggcaaaccg
aggcuacuauuaaauuugguuuuagaagaagauuucugggagaaguguuaaacugcucccaggcuguaucaacc
ccauuaagaaaaaaaaaaauaccaggagaugaaaauuuacuuugaucuguauuuuuuaauuaaaaaaaaucagggaagaaag
gagugauugaaagggaucgugagcgucggcgguccacgguguccucgcuccgcgugcgccagucgcuagcauaucgcca
ucucuuuccccuuaaaagcaaauaaacaaaucaacaauaagcccuuugcccuuccagcgcuuucccaguuauuccagcgg
cgacgcgugucggggaauagagaaaucgucucagaaagcugcgcugauggugugagagcggacugucgcucaggggcgcc
cgcggucucugcacccagggcagcaguguggggauggcgcuggggcagccaccgccgccaggaaggacgugacucuccauccuuu

TABLE 5-continued

Genes down-regulated in HF stem cells.

| Gene Name/protein | Fold Decr | Sequence | SEQ ID No. |
|---|---|---|---|
| | | uacacuucuuucucaaagguuucccgaaagugcccccgccucgaaaacuggggccggugcggggggggagagagguuagg uugaaaaccagcuggacacgucgaguuccuaagugaggcaaagaggcggggguggagcgggcucuggagcggggagucccug ggacucggguccucggauggaccccgugcaaagaccuguuggaacaagaguugcgcuuccgagguuagaacaggccaggcauc uuaggauagucaggucaccccccccccaaccccaccgaguugugguugggaauuucuuggaggaaucuuagccgcgauuc uguagcuggugcaaaaggaggaaaggggugggggaaggaaguggcngngcgggguggccguggggguggaggugguuua aaaaguaagccaagccagagggagaggucgagugcaggccgaaagcuguucucggguuuguagacgcuuggaucgcgcuu gggucuccuuucgugccgguaggaguuguaaagccuuugcaacucugagaucguaaaaaaaaugugaugcgcucuuucu uuggcgacgccuguuuuggaaucugucggaguuagaagcucagacgucccaccccccaccccccgcccacccccucugccuu gaauggcaccgccgaccgguuucugaaggaucugcuuggcuggagcggacgcugagguuggcagacacggugugggggacuc uggcggggcuacuagacaguacuucagaagccgcuccuucuaacuuucccacaccgcucaaaccccgacacccccgcggcgga cugagguuggcgacgggucagagucuucggcugaaaguuagauccgcuaggggucggcugccugucgcuagaagcauuau uggcucucggagaccguguggaggaagugcuggaguguggcgagugugugugugugugugugugugugu gugugugugugugugugugcgcgcccuuggagggguccuaugcgcuuccuuuucauggaacgcugucgugaggcu uuggcuaaacugucuuuucgguccucucucggcugcacuuaagcuuugucggcgcuguaaagagacgcgucuucaagugca cccgauccucaggcuucagauaaaccgccccgaaccuggccagaugcauugcacugcgcgccgcaagguagagacgugccc cacgucccugcgugcagcgacuacgaccgagagccgcgccaguguuguguccgccgagagauccucagagcaggcgggga caacucccagacgcugggucccagcugcgggcgcgggaagguugccucgcucgcaggggcuggaccccagccggggguggga ggauggaggaggggcgggcgggcucuucgugagugggcggggcucucggguccacgugacuccuaggggcuggaagaa aaacagagccuguucugcuccagagucucauuuauaucaaauaucauuuaggagccauuccguagugccauucggagcgacgc acugccgcagcuucucuggccuuuccagcaaguauuggcuccccaagaacuauggacuguuauuauugcccuug uuuucgucagugaguagacaccucuucuuuccuucuuuggaauucacucugucccuccaucccugaccacugucugcc cucccgucgacuuccauuucagugcccgcgcccuacucucaggcagcgcuauggguucucuuucgggucccugcaaggcca gacacucgaaaugacggggcuccuuuuaaagcgcucccacuguuuucucugauccgcugcguugcaagaaagagggagcgcg agggaccaaauagaugaaagguccucagguuggggcugucccuugaagggcuaaccacucccuuaccaguccgauauaucc acuagccugggaaggccaguuccuugccucauaaaaaaaaaaaaaacaaaaaacaaagucguuugggaacaagacucu uuagugagcauuuucaacgcagcgaccacaaugaaauaaaucacaaagucacuggggcagccccuugacuccuuuucccagu cacuggaccuugcugcccggguccaagcccugccggcacagcucuguucccccuccuccuguucuuaaccagcuggaaguug uggaaauugggcuggagggcggagggaaggcgggggugggggguggagaagguggggggggggaggcugaaggucga agugaagagcgauggcauuuuaauucccccucnccuccccccuuuaccuccucaauguuaacuguuuauccuugaagaagc cacgcugagaucauggcucagauagccguugggacaggauggaggcgaucunauuuuggguuauuuugaguguaaacaagu agaccaaguaauuacagggcgauucuuuacuuucgggccgugcauggcugcagcugguguguguguguaggguguga gg gagaaaacacaaacuugaucuuucggaccuguuuuacaucuugaccgucgguugcuaccccuauaugcauaugcagagacau cucuauuucucgcuauugaucggguguuuauuuauucuuuaaccuuccaccccaaccccucccccagagacaccaugauuccu gguaaccgaaugcugaugggucguuuuauuaugccaagccugcuaggaggcgcgagccaugcuaguuugauaccugagacc gggaagaaaaaagucgccgagauucagggccacgcggaggacgccgcucagggcagagccaugagcuccugcgggacuucg aggcgacauucuacagauguuuugggcugcgccgccguccgcagccuagcaaggagccgucauuccgauuacagaaggga ucuuuaccggcuccagucuggggaggaggaggaggaagagcagagccaggggaaccgggcuugaguacccggagcgucccgcc agccgagccaacacugugaggaguuuccaucacgaaggucaguuucugcucuuaguccuggcgguguagggugggguagag crccggggcagaggguggggggugggcagcuggcagggcaagcugaaggggguuguggaagccccggggaagaagaguuca uguuacaucaaagcuccgaguccuggagacugguggaacagggccucuuaccuucaacuuuccagagcugccucugagggguac uuucuggagaccaaguagugguggugauggggagggggguucauuuugggagaagcggacugacaccacucagacuncugcu accnccccagngggguguucuuuagcuauaccaaagncagggauucugcccguuuguuccaaagcaccuacugaauuuaaua uuacancugugguguuugucaggguuaucaauaggggccuuguaauacgaucugaaugcuuccuagcggauguuucuuuuc caaaguaaaucugaguuauuaauccuccagcaucauuacuguguuggaauuuauuuucccuucguaacaugaucaacaag gcgugcucuguguuucuaggaucgcuggggaaauguuuggugaacauacucaaaaguggagagggagagagggguggccccuc uuuuucuuuacaaccacuuguaaagaaaacuguacacaaagccaagaggggggcuuuuaaaagggggguaguuccaaggggugguggag uaaaagaguugacacauggaaauuauuaggcauauaaaggaagguuggagaauacuuucugucuuuggguguuugacaaaugu gagcuaaguuuugcugguuugcuagcugcuccacaacucugucccuucaaauuaaaaaggcacaguaauuucucccccuuagg uuucuacuauauaagcagaauucaaccaauucugcuauuuuuguuuuuguuucuuguuuuuguuuuguuuuguuuuuuu uuuuuuuuuuuuuuuuugucucagaaaagcucaugggccuuuucuuuucccuuucaacugugccuagaacaucugga gaacaucccagggacagugagagcucugcuuuucucuucaaccucagcagucaucucagaaaauugaggguauuccc ucggcagagcuccggcucuuucggagcagguggaccaggggcccugacugggaacagggcuuccaccguauaaacauuuau gagguuaugaagccccagcagaaaugguuccuggacaccucaucacacgacuacuggacaccagacuaguccaucacaaugu gacacgguggaaacuuucgaugugagcccugcagucuucgcuggacccgggaaaagcaacccaauuauggggcuggccauu gaggugcacuccuccaccagacacggaccuccacccagggccagcaugucagaaucagccgaucguuaccucaagggaguggaga uugggcccaaucucgccccuccuggucacuuuuggccauggauggccgggccguucccauuacuauacggugacuucagugcu aguccaagcaucaccccacagcggguccaggaagaagaauaagaacuguccugccauucacuauacgguggacuucagugacgu gggcuggaaugauuggauuguggcccaccccggcuaccaggccuucuaugccauggggacugucccuuccacuggcuga ucaccucaacucaaccaaccaugccauugucagacccuaguucaacucguuaauucuaguauccccuaaggccguuguguc cccacugaacugagugccauuccauguuguaccuggaugaguaugcaagguggguguugaaaaauuuacaggagauggug guagaggggguguggaugccgcugagaucagacagucagcuccggagggcggacacacacacacacacacacacacacacacaca cacacacacgucccauucaaccaccuacacauaccacuacauuaccacauuccuuauagcuguacuuuuuaucuuaaaaaaaaaaa aagaaagaaagaaagaaagaaaaaaauugaaagacagaaaagaaaaaaaaacccuaaacaacucaccuugaccuuauuu augacuuuacgugcaaauguuuugaccauauugaucauauuuugacaaauauauuuauaacuacauauuaaaagaaauaaa augag | |
| IL1r2/Interleukin 1 receptor, type II AV223216 X59769 | 11 | gaaucccacuuacaugcgagcaucucuauauacauccucaaucuauc cccucgaauccacggacuuaucagucaaucaauacuacagucaaagaa uuuuuuucuacguuauccuggagcauugcgcuggcaccucuuuuc uaaucaucuuggguguggggccaauauggaugcgcagacgguguaa acgcagggcuggaaagacauauggacugaccaagcuacggacugaca accaggacuucccuuccagcccaaacuaaaauaaaggaaaugaa | 261 |

TABLE 5-continued

Genes down-regulated in HF stem cells.

| Gene Name/protein | Fold Decr | Sequence | SEQ ID No. |
|---|---|---|---|
| Wnt3a/wingless-related MMTV integration site 3A X56842 | 4 | Sequence below. | 262 | gaauucaugucuuacggucaaggcagagggcccagcgccacugcagccgcgccaccuccca gggccgggccagcccaggcgu
ccgcgcucucgggguggacucccccgcugcgcgcucaagccggcgauggcuccucucggauaccucuuagugcucugcagc
cugaagcaggcucugggcagcuacccgaucggugguccuuggcugugggacccaguacuccucucugagcacucagccca
uucucugugccagcaucccaggccugguaccgaagcagcugcgcuucugcaggaacuacguggagaucaugcccagcguggc
ugaggguguccaaagcgggcauccaggagugccagcaccaguuccgaggccggcguuggaacugcaccaccgucagcaacagc
cuggccaucuuuggcccuguucuggacaaagccaccggagcagcgucaugccaugccaccgcucccgcuggaguagcuu
ucgcagugacacgcuccugugcagagggaucagcugcuaucuguggggugcagcagccgccuccagggcuccccaggcgaggg
cuggaagugggcggcuguaguaggacauugaauuuggaggaauggucucucgggaguuugccgaugcagggagaaccg
gccggaugcccgcucugccaugaaccgucacaacaaugaggcugggcgccaggccaucgccagcacaugcaccucaagugca
aaugccacgggcuaucuggcagcuguugaaggaagaccugcuggguccgccggacuuccgcaccaucgggauuucc
ucaaggacaaguaugacaguggccucgagaauggugguagagaaacaccgagagucucguggcugguggagacccugaggc
cacguuacacguacuucaaggugccgacagaacgcgaccuggucuacuacgaggccucacccaacuucugcgaaccuaacccc
gaaaccggcuccuucgggacgcgugaccgcaccugcaaugugagcucgcauggcauagauggugcgaccuguugugcgc
gggcgcgggcaucaacgcgcgcacugagcgacggaggggagaaaugccacguguuuuccauuggugcugcuacgucagcugc
caggagugcacacgugucuaugacgugcacaccugcaaguaggagagcuccuaacacggagcagggucauuccgagggc
aagguuccuaccuggggcgggguuccuacuuggagggucucuuacuuggggacucgguucuuacuugagggcggagau
ccuaccugugaggucucauaccuaaggacccgguuucugccuucagccuggguccuauuugggaucuggguuccuuuuu
aggggagaagccucugucugggauacgggguucugccggagggugggggccuccacuuggggaauggauuaaauucccaauuuggccg
gaagucccuaccucaaggcuuggacuccucucuuugaccgaccagggcugaggacagggaaggcuacuccccucaacuag
guggggguucgucggaugggugggagggagagauuuagggucccuccuccccagaggcacugcucuaucuagaucaugaga
gggugcuucagggugggcccuauugggcuugaggaucccgugggggcggggcuucaccccgacugggggaacuuuugg
agaccccuccacuggggcaaggcuuccacugaagacucaugggaaugggagcuccacggaaggaggaguuccugagcgagcu
gggcucgagcaggccaucagcucccaucuggcccuuuccgucugcuguugguaagguucaaccgcaagcucaucugccg
agagcaggaucuccuggcagaaugaggcauggagaagaacucagggguguauacaagaccuaacaaccccgugccugggua
ccucuuuuaaagcucugcaccccuucuucaagggcuuuccuagucuccuuggcagagcuuucugaggaagauuugcaguc
ccccagaguucaagugaacacccauagaacagaacagacucuauccugaguagagagggguucucuaggaaucucuauggggga
cugcuaggaaggaucugggcaugacagccucguaugauagccugcaucccgucugacacuuaauacucagaucucccggga
aacccagcucauccgguccgugauguccaugcccaaaugcucagagauguugccucacuuugaguuguaugaacuucgga
gacauggacacaguccaagccgcagagccagggcuguucaggaccauccugauuccccagagccugcuguuggggcaaug
gucaccagauccguuggccaccacccuguccccgagcuucucuagugucugcuggcccuggaagugaggugcuacauacagcc
caucgccacaagcagcuuccugauuggcuaccacugugaaccgucuccccccuccagacaaggaggggaugguggccauaca
ggagugugcccggagagcgcggaaagaggaagagaggcugcacacgcguggugacugacugucuucugccuggaacuuugc
guucgcgcuuguaacuuuauuuucaaugcugcuauauccacccaccacuggauuuagacaaaagugauuuucuuuuuuuu
uuuucuuuucuuucuaugaaagaaauuauuuuaguuuauaguauguuugaaauaaugggggaaaguaaaagagagaa
aaaaaaaaaaaaaaaaaaaaaaaaaaaaaa

| Il12rb2/ Interleukin 12 receptor, beta 2 U64199 | 3 | Sequence below. | 263 | cgcaccggagguccacacugccgcgggacuccagcgauggcgcugcguaggcuagcgggugccaggauccccucucugcgu
ccugugcgcgggaagagcucuggagaaccagaguugcauucggaguugaagacucauggcacagacuguuagagaaugcu
cauuggcacuucuuuuuuugucauuggccugcugauuaaagcaaauauagauguguccaagcuugggcacugugaccguc
agccugcccccugugauuccucuuggguucagcugccaauauuccugcucucgauuccuugaaccuccaaggccuguuucacauuaucc
caguucuaacgaauuaaaucucuuaaaguuugucaaugaugucccuuguugaaaaucuccauggcaagaaaguccaugaccac
acuggucacuccuccacuuuucaagucaccaaccuguccccuugguaugaccuuguuugucugcaagcuaaacuguagcaacu
cucaaaagaagccaccagucccaguauguggggguggagaucuccaguggguguugcuccagagccaccucaaaacauaucaug
uguccaggaaggagaaaauggaacuguggccuguuccuggaacucuggagauaucuuauaacacacuuua
caguuaaguggaccaaacaaucugaccugucagaaacaauguuuuucugacaaucgucagaauugcaaucgccuggaucuug
ggaucaaucuaagcccugauuuagcugaauccagguucauaguccguguuacugccaucaacgaucuugaaauucuucuu
cacuuccgcauacguucacguucuuggacauaugauccucuucuccccguggggacaucagaaucaacuuucuaaaugcuuc
ugggagcagagguacacugcaguggggaagauggaggggccaagguacucaaucaaccucaagaauaucagcucucuuaacagcacg
uccuggaacaugguccaaugcuacaaaugcaaaggaaaauaugaccugcgagaucugagaccguuuacagaauaugaauuuc
aaauucuccucuaagcuacaucucucuggaggaaguugaguaauuggagugagucacugagaacacgaacaccagaggaaga
gccuguggggauauuagacaucuggacaugaaacaagacaucgacuaugacagacagcagaucucucuuuucuggaagagu
cugaauccaucagaggcaaggggagaacucccacuaucagggacguuacaaggggacaaagaaaacaacaccgcagaaa
uacuacaagacacaccuccuggaccagggucaucccccgaacuggggcuuggacggcaucacugucucugcagccaaucucaaaag
gcgcuucugcacccacucacauuaacauaugguggaccuaugggcacugggguucuggcuccuccaccaggucucugcaaaguc
ggagaacauggcaacauucuaguggaccuggcagccuccuaagaaagcugauucugcuguucgggaguacauaguggaaug
gagagcucccaaccagggagcaucacgaaguuucccccacacuggcugcggaccccccggacaacaugucugcucucugauu
ucagagaacauaaagcccuauaucuguuaugaaaucagggugcaugcacugucagagcccaagggggugcagcuccauc
ggggugacuccaagcacaaagcaccagugauggcccucacauuacugccaucacagagaaaaggaacgccuuuucauuccc
ugacccacauuccauuccggagcaaggggcugcauccuccauuacgaauauacuggaaagaacgagacucgacagcaca
accugcucgaaaaucacaguaccgacgcucucaaaaccucaacauccaauaagcgcucuacgccacagacauauugucc
uauggaugacagcugugacacgcugcugggaaguccccaaggaaaugaagggauuuugccacagggcaaagccaacug
gaaagcaucgugauaucaagcauuugcaucgcuaucaucacgguggcacguucuacguucagacucuucucaauuuccggcaaaaggca
uuuacucuccugucuacucucaaaccucaagguauagcagaaccauccagauccagcaaacagcacuggguaaagaagu
auccauucuggaggagaagauccagcuaccacggauaaucuccugauggcauggcccacuccugaagagccugagccccu
gaucauccaugaaguccucuaccacauguccccaguugucagacaaccauauuacuucaaaagaggccaaggauuccaaggcu

TABLE 5-continued

Genes down-regulated in HF stem cells.

| Gene Name/protein | Fold Decr | Sequence | SEQ ID No. |
|---|---|---|---| acucuaccuccaagcaagaugcaauguauauugccaauccacaagcuacaggaacucucacagcugagaccagacaacuagug
aaccuauacaaggugcuagaaagcagagacccugacucaaaacuggccaaccugaccagccccuugacagucaccccagugaa
cuaccuuccuagccaugaaggcuauuuaccuccaacauagaagaucugucaccacaugaggcugacccaacugauucuuuu
gaccuggagcaucaacauauuucucuuuccauuuugcaucaaguucucuccgcccacucaucuucgguggugagcggcug
acucuagaucgguuaaagauggcuaugacucccucaugaguaaugaggcuugauacuagaaagccaacguaccucauuuua
ucugccaguuccuacuccaaaggucuguagacagugaagacaagccagcugucucuggauaaaguuagcuucaccauaggua
cuuaagucuuauggauaaggugcaauacaccaacacugauaucauauagaaaggaccccaagauagucaugcuc

| Wnt10a/Wingless-related MMTV integration site 10a U61969 | 3 | Sequence below. | 264 | ggcacgaguucaccucucugcaugcguucccccucccccucuccagcaaacacggcgcgccaguccaaagcggacucaguggcc
ucggggacgggagcaugccaccuccuguggugacgucacuugggguagacccuuagacacacuagggggggggggguac
agaacucccgagccaggacagucacucacucuucaggcggugggcugggccagacaguaccgccccaccgcgcccgcccucg
cacaccucggaagcgcaggcucgcagcgcggcgcuggggugggggguugcgcccagaacuucggccuccagucccagcc
cgcugcaccuccuuaccccucuagaggcccccuccccuuacccucuagaggcaccaggaguugucgcaaggggcccuuggga
aauuccuggacccugugccaggaggugcccggucgcccgucccaucaccccccgagggcggugccgggggcgcu
gccccauggagcggggaggcgggcgcugucugcgggagcugugaccugaguaggagcugugugugcagccgccccac
cccugccgaucaugcgccggcgacccuggucgccagucacugggcugugagccccccacuccuggccugucacggcccg
cgcgccaugggcagcgcccacccucgcccuggcugcggcucccacaagggcccccagccgcggccugaguucugggcgcucc
uguucuccuacugcugcuggcugccgcugugccucaggucagcacccaacgacaucugggcccucgccuaccccccagagcc
cgugcucaacgccaacacagugugcugacauugcccggccugagccggcggcgagauggagggugugcgucacccugac
guggccgccucugcuauccagggcauccagaucgccauccaugagugcagcaucaguuccgggaccagcgcuggaacugcu
ccagccuggagacucgaacaaaguccccuacgagagccccaucuucagccgagguuucgagagagugcuuucgccuacgc
cauagcagcugccggggugugcacgcagugccaacgcgugcgcucugguaaacugaaggcuugcgguugcgacgccuc
cagacguggggacgaagaagcuuuccgucggaagcugcaccgcuugcagcuggacgcgcugcagccgcaaccgcuuccaccgcgccacgc
cacgggucccugaacaccggccauacuuccugccagcccaggucugcaggacuccuggagugggguggcugcagucccgg
auguggcuucggagaacgcuucucuaaggacuuucuggacucccgagagccucacagagacauccaugcucgaaugagacu
ccacaacaaccguguggccggcaggcggugauggagaacaugcggcguaagugcaaaugccacggcaccucaggcagcugc
cagcucaagaccugcuggcaggugacgccugaguuccgcacaguagggggcgcugccggcaaccgcuuccaccgcgccacgc
ucauccggccgcacaaccgcaacgguggccagcuggagcccggccccgcgggagcacccucgccagcaccgggcacuccaggg
cugcgccgcagggccagccacuccgaccuggucuacuuugagaaaucucccgacuucugugagcgcgagccgcgccuggacu
cggcaggcacuggggccgccugucaauaagagcagcacggguccccgaugcggcgcagcaugugcuguggccgcggcc
acaacauucgccagacgcgcagcgagcgcugccacugccggucccacggugcugcuucgugggucugcgaagaaugccg
caucaccgaguggucagcgucugcaagagcagacccaagcuccucuggggucucaagaauggguugccucuugguugccu
ggcuucugccgcuagcggaucugagccaggcagcaagcagcagccuuggcucgagagagguggguuggcucuuacagcccc
gagggucuacaaucaccagacaguccagaucugauugacauuccuccgcucaccucguagguucccccucuuucuguuccua
gcucagacaggggguauaugggacuguuccacaccuaggacagcacccaagcugcccucuggcaugccuac
cuccugucaucucuucuucccuucccaggagugauaggcaaugcacgaagcaugggcaccggggaagaaaacuaaaag
gcagaaauggccgucaucgggcugaagugacucuaagggcuccagaccucgucccugucuuucacuuaacagauauuau
uuuugcgcucucuuugagacacucucgggggaaaagaagcuccggagucuacaggcugauuaagggacauggacaauaaac
caguaaacacacaaaaaaaaaaaaaaaaaaa

| Ifngr2/Interferon-gamma receptor precursor M28233 | 3 | Sequence below. | 265 | gaauuccgggccgcuugcacuuggcgacuagucugcggcggacgugacgccaaggccacgggcagcgcgggucccugucag
aggugucccucgcgcaggaaugggcccgcaggcggcagcuggcaggaugauucgcuggguguccugaugcugucugcgaa
ggucgggaguggagcuuugacgagcagcaccgaggauccugugagcccuccugugccugacgcgaauguucuaauuaaguc
uuauaacuugaaccugucguaugcugggaauaccagaacaugcacagacuccuauuuuuacuguacagguaaaggugua
uucgggguuccuggacugauuccugcaccaacauuucugaucaugguguaauaucuaugaacaaauuaguauccugaugu
aucgccugggccagaguuaaagcuaagguugacaaaaagaacugacuaugcacggucaaaagaguuccuuaugugccuaa
aagggaaaggucgggccccuggccuggcuggaggaaggaagaacagcucucccucgucccguauuucacccugaag
ucguugugaauggagagaagccaggggaaccaugguuggugacgggagcaccuguacacauucgacuauacuguguauggg
agcauaaccggagugggagauccuacauacgaaauacgucgaaaaagaagagugauaugacucucgugagauuaaa
caucucaguauccacacuggauuccagauauuguauucaguagacggaaaucucaucuuucuggcaaguuagaacagaaaaa
ucgaaagacgucuguaucccuccuuuccauggagacaggaagggaguuucaauuuugauuccugcccucucuuuaaccguc
uuuacaguaguuauccugguauuugcguauuggauauacuaagaagaaucauucaagagaaaaagcauaauguuaccuaag
uccuugcucucuguggucaaaagugccacguuagacaaaccugaaucgaaguauucacuugucacaccgcaccagccag
cuguccuagagagugagacggugaucugugaagagcccugucacagugacagcuccagacagcccgaagcagcagaaca
ggaagaacuuucaaaagaaacaaaggcucuggaggcuggaggagacgcucgcucaagaccccagacagcccccuccaacucga
cacaaagacgcagcuuucccguuaaguaguaaccagucaggcccuuguagcucaccgccuaucacuccgaaacggcuc
ugacagugccucgugggaucggcagcccauaucggacuggaaucucucccaaacaacaacucagaaacaaagaugca
gagcacgaccuccaccgugagaaaggccccauggccuccgguuaugacaaaccgcacauguggguggacgugcuuggg
auguugggggaaggagucucauggggauagacucacaggagaggcccaggagcugucucuaagggucuccgaggccug
cuggugguaaaacugaccuuuuaggcaguuuucugcauuguuugcaugauaaagaagcuauacauuagcuaauacuaac
cacauagaauaucagacuuagauacgugaauaaggaucucguggcacugcuggguccacucugcaaaugccaagacuauca
aaggaacguauugucgcuucuggcuccuucccaggugggcuagcaucugugaguugccucggcuagccuugcuuccuaca
gccgccacugcuccucaccccugaucaucuacaggacaggguggaccggguuuuuuuuuuuuuuuucacacaccuuuguau
auguaaguucauguauauaauauguuuacauguuucacuuugaacugaaagcuacucaaagccagccguaagucuauggua TABLE 5-continued Genes down-regulated in HF stem cells.

| Gene Name/protein | Fold Decr | Sequence | SEQ ID No. |
|---|---|---|---|
| | | gaaugugauggaacauguuggugggaagcuuguacaauagaacacauuggugggagcuuguacauacuuuuuuauggagcau uacuuacgauuuuuuaaguaaaauguuuugaaaccaaaaaaaaaaaaaggaauuc | |
| Fgfbp1/ Fibroblast growth factor binding protein 1 AF065441 | 3 | augagacuccacagccucauccugcucuccuuccuucuccuggcuac ucaggcguucucagaaaaggucagaaagagagccaagaacgcaccaca cagcacagcggaggaggggguagagggguucagcucccucguuaggga aggcccagaauaagcagagaagcaggacaucuaaaucucugacgcaug gcaaguuugucaccaaagaccaagccacaugcagauggggcugugacu gaggaggagcagggcaucagccugaaggucagugcacacaagccga ucaggaguuuucuugugguuuugcuggugacccaacugacugccuu aaacacgacaaagaccagaucuacuggaaacagguugcccgcacgcug cgcaaacagaaaaauaucugcaggaacgccaagagugucuugaagacc agagugugcagaaagagauuuccagagucuaaccucaagcuggugaa ccccaacgcacgugaaacacgaagcccaggaaggagaaagcagaggu cuccgcaagggagcacaacaaggccaagaagcugucuccacggagcc aaacagggucaaagaagaacaucacacucaauccagcugcgaccagac cauggccauuagagauccagagugucuagaggauccagaugugcuca accagaggaagaccgcccuggaguucugugggggaaucuuggagcucc auuugcacauucuuccucaacauguuacaggcgacaucaugcuaa | 266 |

Transcription Factors and Related Genes

| Gene Name/protein | Fold Decr | Sequence | SEQ ID No. |
|---|---|---|---|
| Klf5/Kruppel-like factor 5 AA611766 | 5 | aauucgucgacaugcgccguuccagugcauggugugccaacgcagcu ucucccgcuccgaccaccucgcgcugcacaugaagcgccaccagaacu gagcgagcgagcgcugcccaccccgccugacgccuugcaguccgcuc ugccauccuuuaaaccgcagaccuaacuucauaaaaaga | 267 |
| Gata3/GATA binding protein 3 X55123 | 4 | Sequence below. | 268 |
| | | gcuaaacuaucccgcaaagauuuucuuccucccuaaacccuccuuuuugcucuccuuuucuauacccuuaacugcaaaca aaccauuaaacgaccccucuccuggggccuccgacggcaggagucccgcggaccucccaggccgacagcccucccucucccgcg agguucgggcgggcgagagggcgcgagcaccagccgaggacaccuggagguagcgcugcggagcgcgcgugggugagccacc aucaccccgcgguccucaacgucagcacccagacacgcaccaccccgggccucggccauucgacauggaagcucaguauccg cugacggaagagguggacguacuuuuuaacaucgauggucaaggcaaccacgucccguccuacuacggaaacuccgucaggg cuacggugcagagguauccuccgacccaccacgggagccagguaugccgcccgcucugcugcacggaucucugcccuggcu ggauggcggcaaagcccugacggccaccacaccgccucgccccugggaaccucaagacguccauccaccacg gcucuccgggggccucguccguuuaccuccggcuucauccucuuucugguggggccggccacuccaguccucaucucuuuac cuuccccgccacccgccgaaagacgucucccagacccgucgcuguccaccccggaucccgcgggcucggccaggcaagaug agaaagagugccucaaguaucaggugcagcugccagauagcaugaagcuggagacgucucacucucgaggcagcaugaccac ccuggguggccgccucccaccucagccccaccccccauuaccacucaauccgcccuaugugcccgaguacagcucuggacucuuc ccacccagcagccugcugggaggauccccuaccggguucgggauguaagucgaggccaaggcacgauccagcacagaaggca gggagugugugaacugcggggcaaccucuaccccacuguggcggcgagaugguaccgggcacuaccuuugcaaugccugcg gacucuaccauaaaaugaaugggcagaaccggcccccuuaucaagcccaagcgaaggcugucggcagcaaggagagcagggaca uccugcgcgaacugcagaccaccaccacccucucuggaggaggaacgcuaaauggggcccggcugcaaugccugugggc uguacuacaagcuucauaauauuuaacagaccccugacuauggaagaaagaaggcauccagacccgaaaccggaagugucuagc aaaucgaaaaagugcaaaaggugcaugacgcgcuggaggacuuccccaagagcagcccuucaacccggccgcucucuccag acacauguucauccugagccacacucucucccuucagccacuccagccacaugcugaccacaccgacgcccaugcauccgcccu ccggccucuccuucggacccucaccaccccucccagccaguggcacugggguuuagaggcagagcccugcuccacaugcg ugaggagcuccaagugugcgaagaguuccuccgaccccuucuacuugcguuuuccgcaggcaguaucaugaagcccgaa agcgacagaucugguuuuugaaggcagaaagcaaaauguuugcuucuuuuucaaaggagcucgaggugguguccugcauu ccaaccacugaauccggaucccauuugugaauaagccauucagacucauauucccuauuuaaacaggguccuagugcuguga aaaaauauugcugaacauugcauauaacuuauauugaagaaauacuguacauuugaggaagacuuuauuguaccuggau agcuguaagaaaggcaugaaggacgccaagaguuuuaaggaauaagggnnuuaaaguauggagauacagaagaaaccacu aagucugaugucccaaaugggcacacugucaguuuuguuccucaguuguuugaugcauuuaaaaaaaaaaaaaagaaagaa | |
| Stimulated by retinoic acid 14, basic-helix-loop-helix protein Y07836 | 3 | Sequence below. | 269 |
| | | caaccaccuccuacugccugcccaaagcuccagggcuggagcacggagaccugucaggggauggauuuugcccacauguacc aagugucacaaguccaggcggggaauaaaacgagcgaagacagcaaggaaacuuacaaacugccgcaccggcugauugagaaa aagagacgugaccggauuaacgagugcauugcccagcugaaggaucuccuacccgaacaucucaaacuuacuacuuugggguc acuuggaaaaagcaguggucuggagcuuacguugaagcagcugaagacauugacaaauugaacagcagcagugaa aaucauugcccugcagagcgguuucaagcuggugauuucgggaagaaaucucgaggcagggcaagaaauguucugcuc aggguuccagacuugucccgugagguacuucaguaccuggcgaagcaugagaacacucgggaccugaaaucuucccagcuc gucacucaucuccaucgugugguccucggagcugcugcagggguggugcuuccaggaaaccauuggacucggcucccaaagcc gcgacuugaaagagaagcccagcuucccaagggaucagaaggccccaggggaaaaaacuguugccaguccagucagcggca cuuuugucccucggguggggagcagagcggcagugacacggacacagacaguguguauggugaauuggagaagggg acuugcgcagugaacagccguacuucaaaagcgaccauggacgcaggguucgccgugggagaacgugucagcacaauuaagca agaauccgaagagccccaccacaaagagccgaaugcagcucucagaagaggaaggccacuucgcgggcagugaucugaugg guucccauuucuugggccacacccacaucagccuccuuuugccuucccuucuaucucauccaccaucggccacugccua ccugccuauggcuggagaaaugcugguacccccacucugugccagugujuuauacccaggccucaacaccucagcugcagcccuc | |

TABLE 5-continued

Genes down-regulated in HF stem cells.

| Gene Name/protein | Fold Decr | Sequence | SEQ ID No. |
|---|---|---|---| uccagcuucaugaacccagacaagauaccgacucccuugcuucugccccagagacucccuucuccuuuggcacauucguccc
uugacucuucgccuugcuccaggcuuugaagcagauccccuuuaaacuuagaaaccaaagacuaaacucuggagggauc
uccugcugccuugcuuucuuuccucccuaauuccaaaaaccacgaagguuucccugagugcagagagaucagcccacccugc
agacccacagagaagauucagagugugugagagugagugagugugcgugcgugcgugcuuguauguauguuuguauau
guaggacaauaaguuccuucugacacaagggagacacgagaaggauagccugacaucagaugacagacuggaggacuguagc
acaucucugggcguuucccuacccagagaagagcc

Cell Cycle Related

| Mki67/antigen identified by monoclonal antibody Ki67 X82786 | 4 | Sequence below. | 270 |
|---|---|---|---| agucaccgacguuguauaacgacggccagugaauuguaauacgacucacuauagggcgaauugggguaccggccccccccucg
aggucgacgguaucgauaagcuugauaaucgaauucucgnccgcgugcggugucuucgggggcggagcgaaggccgcggguggug
gccguggucgguccuccgcggcuaaggagccgagggcuccgacgcgggcugcgcccggugagcggcggccagagcuaacuu
gcgcugacuggaccagcugaggagcggcccggcggggcgacugcgagcuucaccgagaggcuuccccgcccuggcccgcagu
cccgacggccgggcggaccauggcguccucgcucaccuggucaccaucaagcggagcggcgaugacggcgcacacuucccg
cugagccucagcucccugccuguuuggaaggagcuauugaaugugacacucguaccgcgcguguguagugucucaaagacau
ugcccaauguaguccaagagcaagaggcgauauuauauaauuucaguucuaccaauccaacucaacuaaacgggguuacua
uagaugagccugugaggcugagacaugagacauaauaaccaucauugaccgcuccuuuaggauaaugaagauggaaaucauga
ggauggaagcaaaccaacagaauucccaggaaaguccuugaaagaaccaucaaggcgagccucaagagauagcuucugu
gcugacccugauggggaaggucaagaauaccaaagcuuccaaaaugaacugcuucaagaagacuuuuuuguaugcccaagggcc
uuucgcagauagcccugccucagaugggcucaaagaacaguguuagcccaagacucaucagggcauguagaacagcacacug
cagaaacauaguagagcccacuucgggggaucucuuuuuaagaaguccaggcucugacagggagcaguuacagggaaccgaagu
cuucuuccaucaacacagagccuuagcaauagcaacgaaaaggaaucucccuuugaaaacuuuaucaaucaaugaaggaagagu
uggaauguaaaauccagaaaucuuguaggaaaucagaaccccaacucugaccgugcagcagaggaaucgcgggagacacagcua
uuggugucaggcagggcaagagcaagaucuaggggaaggcacccccugguacugcagccucuuccacccaaaguaggaaagaucu
ggacugagagauggcgcggugggaaugggugccugucccagacuuccacagagacagcuaaaaugaagaccccugugcggcauuc
acagcaacuuaaggaugaagacucucgugcuuuacuggcagacgacauucugugaaucuggaugaagguggaagugcccaggca
guccauaaaaacagucacuccuggggaaacuggcgacuagaaaccaaacuccgguggaggcuggggauguuggcagcccgcug
auacaccagaacauuccucuuccccccagagaaguaauuccugaaggaguagagguccaucugcagagacacaaaaucggcuc
ucuuuaacucagccccuuguucaggugaaaagaaaacuccccaagggguucuucagcaagccugagaaacuggccacagccg
ccgaacagacuugccuggccuaccuggucuuaguucccguugauaucagcaacuuuggugauuccauuaacaagagugagg
gaaugccuaugaagagaagacguguauccuuugguggacaucuaagaccugaauuauuugaugaaaacuugccuccuaauac
accacugaaaagaggagaaacgccaaccaagaggaagaugucuccuuagcacagcccagcugcugcuccuccaagacaaucaucaagg
aacggcccccagucuccaggaaacaagagucuccuggugauaacgccaccgaggacaaaugaucaaagacgcagaucaggcagg
acuuccagugaagcaauucuuaugugaacagacauucccaagaaagcaggcaggaagagcgguaaccugccugcgaaga
gagcauccaucagccggagucagcaugcauucuacagaugauuugcuccaaaaggccgaaguggagcuucugaagccaacuu
gauuguugcaaaaucaugggcugaugugugaaaacuuggcgugaaacaaacaaacgaaaguugccgaaacaugucccucca
aagcagacgagcaagagacaaagaagacccagcacuccaaagaaacccacaagcaaucuucacaaucaauuuacuacaggccau
gcaaacucuccccuguaccauuguaguaggaguagagcgcagauugaaaaguaaguaguggccugcccgaccccuacaaaaugcuga
auaacuugaugcuaaaccgaaaaguggacuucagugaagaucuagucaggacuaacugaaauaugcuucaagacuccagugaagga
gaagcagcagcagaugagugaaucaggccuccguacuuuccaaaucaggcgaauuugcucagaacacaaaugcaaguaacuaau
ucaggagacauaccugagcccaucaccacagagauuuugggagaaaaaaaaugucuauccaguacucggaaugcagcaaagcagca
gucugauagauauucugcaaguccuaccuuaagacgcgcggagcaucaaaacaugaaaacacagucaaacuccuaagaaaugua
cauaacauuacugaccuugagaagaagacuccggucucugagacagagcccucaaagacucaaucgagugugagcaaguuaaa
gaagaucuagagagcucagacauaccccuugugggaaacuauugaaaugaagaacagaagcaguccuuugcugagaaccaccacaaga
agacauuuaaggggggcauuucgagaacaaaaaguaagaucaacaggugcaggacaaaugaaaaacgcuccucaaagaugcaagga
aaguggugaauuaaguaagguucagaaaagacaucagcuaggagaucaagugccaggaagcagaagccgacaaaagacuua
cuaggaagucagaugggucacccaaacagcagacauagcugaggaacuacuuagucaaggacaaggaaccaucaaaaaccugaga
ggaauccaugcacaugcaaaacacaucaauaagugaggaucaaggaauuacagaaaagaaagugaacauaauaguauauagcaa
ccaaagagaagcacucgccaagacccccuggccaaaaaagccaaccucuagaaggcgcagcugguacuaaggaacacuuugaa
acaccaaaccccaaagauaaaccuauaacggaagacagaacuagaguccuuugcaaaucaccacaagucacaacagagaauauc
acaacaaacacaaagccacagacuagcacaucgggaagaaaguagacaugaaggaagaaagcucugccuugacaaaacguau
acauaugccagggggaauccaggcauaauccccaaaauuuuuaaaacuugaguggugaggauaucaaagcuuugaagcaaucgaa
aaugaaaugcugaccucaacaguaaaagugaggacaaaggacauuugggaaaaacuaaaaaaaaggcucagcccguggaagaccu
gacuuguuccaggaacucuuuuauaucaccaguuccuacuaaacauaaucaaaaaaauuuccagcaaaucuccacacacacaac
cagucagaaccccagccgagcacaaaagagacucuccaagacaggcucucaguaaagugauguguagacaagaaccuucaacacuu
gggaaaagaacgaagucaccaggcagagccccaggcacaccagcaccagugcaggaagaaaaugacugcacagccuacugga
aacuccaaagcagaacaggagcuauagaaauuaacagggcuuuaggaaacaguccaguaucuuaggaaacaucacuggguu
uccaggauaguuuccaaauaccagaucaugcuaauggcccauuauugguugucaaaaccaaaaaaauguucuuuaauucucc
acaaccagaaagugccauaacccgaaagagcagagagagacagucugggcaaguauaaguaaaauagauguuuaaagaagaac
uuuuagaaucagaggaacaccuacaauuaggagaaggguguagacacauucagguauccaccaacaaagucauuagaucauc
uaggaaaccugcaaagcguaaacuggaaucaacagcuggauagccugcauaagaggaugcgcuguccuuucaaaggauaac
acaccaugccuagaagaccugaauggcuuucaagagcucuuccaaaugccaggcuaugcuaaugacucuuuugaccacuggaa
ucucaacaaugcuuucuagaucaccacaauuaggaccaguuagaacccaaaucaacaaaaagagucugcccaagaucaucuug
agaaaauggaugugacagaagaaauuucaggucucuggaagcagucacugggcagaguccacaccacaagagcaggagg
auaaugcaaucaaagccaauuauggagaaacuaaugucagacgcagcagcagcagaugguccuggcuuacggucaacagagcagca
caaacaccuaaggaaaaaguucaaccgcuggaagaucacagugucuuccaagaacucuuccaaacaucacgcuacguuucga
uccauuaauugguaacaaacaaacaagaaugccuugacaucuccacaaccaggauuuguuagaacuccacgaaccucaaaga
gacuggcuaagacaagugugggaauauugcuguggaagagaaaaagaucucuccagugaucugccacagugugcuacaggggg
agguugacacauacccauagggccagaagaugacacagagaacaaaggugugaaggaauccacaccucagacacuggacucu
ucagcaagucgaacugucagcaagaggcagcaagggggcacaugagggaaaggccucaguucucaggagacuuauuucaucccc TABLE 5-continued Genes down-regulated in HF stem cells.

| Gene Name/protein | Fold Decr | Sequence | SEQ ID No. |
|---|---|---|---|
| | | aagagcucuuucaaacaccagccaguggcaaagacccaguaacuguugaugaaacuacaaaaauagcucugcagucuccacaa<br>ccaggacauaucauaaacccagcaagcaugaagagacaguccaacaugagcucaggaaagacaugagagaauuuuccauacu<br>ugaaaaacaaacacagucacgaggcagagacgcaggcacaccagcaccaaugcaggaagaaaauggcaccacagccauuaugga<br>aacaccaaagcagaaacuggauuucauaggaaauucaacaggacauaagaggaggccucggacacccaaaaacagggcucagc<br>cccuagaagaccuggauggcuuccaagaacucuuucaaacaccagcugguguccagugacccugugagaguguugaagaaagugc<br>aaagauaucuuuggcaucuucacaagcagaaccagucagaaccccagcaaguacaaagagacgcuccaagacaggucucagua<br>aaguggaugugagacaagaaccuucaacacuugggaaaagaaugaagucacuaggcagagccccaggcacaccagcaccagug<br>caggaagaaaaugacagcacagccuucauggaaacuccaaagcagaaacuggauuucacaggaaaauucaucaggacauaagag<br>gaggccacagacaccuaagaucagggcucagcccccuagaagaccuggauggcuuccaagaacucuuccaaacaccagcuggug<br>ccaaugacucagugacuguugaggaaagucaaagaugucuuuggaaucuucacaagcagaaccagucaaaaccccggcaag<br>cacaaagagacucuccaagacaggucucaguaagguggaugugagagaagacccuucaauacuugagaaaaaaacaaagucac<br>caggcaccaccagcaccagugcaggaagaaaaaugacugcacagccuucauggaaacuccaaagcagaaacuggauuucacagga<br>aauucaucaggacauaagaggaggccacggacaccuaagaucagagcucagcccccuagaagaccuggauggcuuccaagaacu<br>cuuccaaacaccagcuggugcuagugacacagugacuguugaggaaagugcaaagaugucuuuggaaucuucacaagcaaaa<br>ccagucaaaaccccggcaagcacaaagagacucuccaagacaggucucaguaagguggaugugagagaagacccuucaacacu<br>uggaaaaaaacaaagucaccaggcagagcccccaggcacaccagcacgagcagugcaggaagaaaaugacagcagccuucaugg<br>aaacuccaaagcagaaacuggauuuugcagagaauucaucagggaguaagaaggucacgaacaucuaagaacaggucuca<br>gccccuagaagaccuggauggcuuccaagaacucuuccaaacaccagcuggugcaguaacccugugagguguugaagaaagu<br>gcaaagauaucuuuggaaucuucacaagcagaaccagucagaaccccgggcaagcacaaagagacuuccaagacaggucucaa<br>uaagaugguugagagaagggcacucuccgcucaguaagucaagcugugcaucacagaaagucaugcaaacccucacauu<br>ggagaagaucauggcagagagacaaagauggggaagguauuguuagcucagaaauuggaaccagcaauauaugauacucgug<br>gcaagaggcagcaaaggucauguaagaaaaaggucccaguccccagaagaccucucuggguucaggaggucuuccaaacauc<br>aggcauaacaaggauucagugacaguggacaaucuugcaaaacugcccagccucgucuccaccacuagagccaacagacacuu<br>caguaaccucacggagacaggccagaacuggucuggaggaaaguucacgugaaaaaugaacuuucaggaggcauaaugcaucc<br>acaaauaucagggaaauugggacuuaccuagagaaccagaaggugaaaggcaaagucauuaaaacaaggagcaaucugua<br>aaacggaaauuggacacagaagucaaugugccucgcaguaagaggcaaagaauuacaagagcagaaaagacccuagaggaucu<br>gccuggcuuccaagagcucugccaagcuccaagcuugguaauggacacguuauuguugagaaaaccccaaagaugcccgac<br>aaaucuccagaaccuguggauacaacuucagagacacaggcaagaagaagacucaggagacugguuguuacugaagagccca<br>uaccacaaagaagacuacaagaguuguaaggcaaaccagaaacacacgaggucaauaagaucaaucaagguauggga<br>gaguuaaggaaucuucaguacagaaacaagacccaaguguaaguuuaacuggcaggaggaaccaaccaaggacaguuaagg<br>agaaacccaacccuuagaagaacucaccaguuuccaagaggaaacugcaaaagaauaucuuccaaaucuccacaaccggaag<br>agaaggaaaccuuagcagguuuaaagaggcagcucagaauacaacuaaucaacgauggguguaaaagaagagcccacagcacag<br>agaaagcaaccauccagggaaacccaggaacacacucaaagagccguaggcuguaggggcuguauaaauguugaagaggguuaagaaguc<br>uacaaagcagaaaauugauccaguagcaagugugccugcagcaagaggccacggagggacccaaggaaaaggcacaggccc<br>uagaauuggcuggucucaaaggaccaauccaaacccuaggccacacugaugaaucagcaagugauaaaggacccacacagaug<br>cccguaauucucuacaaccagagcaaguugacagcuuccaaagcucaccaaggcgacccaggacaagacgugggaaaguaga<br>ggcagaugaagagccuucagcuaagaaaagacaguaacaacaucaagcgauccccgcaaggucccugaaauug<br>guaacaauggauaccccaaguuucaaaggccuccauaaagcagacauuagauacaguagcaaaguaacuggcagcaggaggcag<br>cuaaggacacauaaaggauggggguucaacccucuugaaguuguuaggugacuccaaagaaauaacccaaauaucagaucacu<br>cugagaaacuagcacaugacaccaguauccuuaagagcacucaacagcaaaagccagacucaguaaaaccucugagaacaugc<br>agaagagugcugagggccucuaaagaggucccaaggaaguuuggugacccagagccaugcaacaauucaaagcaaaa<br>gcaacccuuugcugucccccgaagaggaagucugcaagaugaaggcauugugagaaccagggcuuugcgcucuuuagcacc<br>aaagcaggaagcaacagaugagaagccuguaccugagaaaaaaagggcugcuuccagcaagagguauguauccugagccu<br>gugaagaugaaacaccugaaaucgugucaaacaaacuugaaucugguggaagagcagguuagcacuguuaugaaaacagaag<br>aaauggaagccaaaagagaaaauccugucacuccagaacaguccuggaaaaaccaauguaaaacagcacaagg<br>cccaaguuugaugcaucugcagagaaugucgggauaaagaaaaacgagaagacuaugaagacugcuccccaggagacagagc<br>ugcagaauccagaugauggagccaagaaaucuacaucucggggcaagucaguggaaaagaacaugcuugaggucuagagg<br>aacgacugagaugcccagccuugugaagcagaagagaaaacaagcaaaccagcugcagaaaucuugauaaagcucuaggaag<br>agaaaggaguccuggagagucugauguuaggguguuuggaggccagaaaaacuagagucguuuggcacagugaaccuaagc<br>caagggguaacucguggaaccaagaaaugcaaaaacucugaaggaggaugacauuguaugcaccaagaguuaagaaca<br>agaaguuaagaacaagaaguuaccagaaaagugaaacuauguagcaaagacauuuaaggaggaaaaguaaauuugacuuagu<br>gauaaguccaguguggguuucaccuccaguguaaagaugaacuguaaauacuacugcuacugccugaguuuaaggaagga<br>agcuuugagcuuuccuggucauacucucuucagacgccaaaggaggucaugaggaagaucaccagggaucucagcgcaauua<br>caguuaggggugagcaggcagaaaugugggcccucuguccuauccaauaaagcucugaaauucgcugccaaaa | |
| Cks2/CDC28 protein kinase regulatory subunit 2, sim to cdk regulatory subunit 2 AA681998 | 4 | gacguagagcccuugcgcccgguuuccugauccgcuuacuc<br>cucugcgcgccggcaggauggcccacaagcagaucuacuacuca<br>gacaaguacuucgaugagcacuacgaguaccggcaugucaugu<br>uacccagagaacucucuaaacaaguacccaaaaacucaucugaug<br>uccgaagaggaguggaggagacuuggugccaacagagucuag<br>gauggguucauuacaugauucaugagccagaaccgcauauucu<br>ucucuuuagacgaccucuuccaaaagaacaacaaaaaugaagug<br>cagcuggggaucaucuaaucuuuuucaaauuuaaguguauaugu<br>guauauaagguaguauucaguaguaauacuugaaaaguguacaaa<br>ccuuucauccauaccugugcaugcgcuguauucuucacagcaa<br>cagagcucagucaaaugcaacugcaaguagg | 271 |
| Ccng2/<br>Cyclin G2<br>U95826 | 3 | Sequence below. | 272 |
| | | cuacccuagacaaucacggcuuagccggcgcgcggagucgaucgucucggucgcuagagcugucccugagcucgaacgguccg<br>acgccccgccgcgccgguccgugacgccggggccgacacgaugaaggauuuggggccaagcacuggcagguggcgaagg<br>gguucagcuuuccgaauuguugaacuucaccuggaacaagaacagagauaccaaccucgggaaaaagggcugaucuugaug<br>gaggcuaccccggagaaugauaacacuuuguguucaagacugagaaaugccaaaguggaagauuuaagaaguuuaacuaacu<br>ucuuuggaucuggcacugaaacuuucguucuggcugucaauauuuuggauagauucuuggcccuuaugaaggugaaaccga | |

TABLE 5-continued

Genes down-regulated in HF stem cells.

| Gene Name/protein | Fold Decr | Sequence | SEQ ID No. |
|---|---|---|---|
| | | aacaccuguccugcauuggcgucugcugcuuuuugcuggccgccaggcuggcggaagaagaaggugacguucccccacgca cgacgugauccgcaucagucaguguaaaugcacagcgucugacauuaaacgcauggagaaaaucaucucagagaaacugcac uaugagcuggaagcuaccacugccuuaaacuuuuugcacuuguaccacgcgauuguauuuugucacacuucagaaaggaag gagauucucagccucgauaaacucgaagcgcagcugaaagcuugcaacugccgaguugucuucuccaaagcaagaccaucug uauuagcucugugccuucucaauuuggaaauagaaacgauaaaauccguggaacugcuggaaauucucuugcuuguuaaaa aacauuugaagcucagcgacacugaauucuuuuacuggagggaacugguuucuaaaugcuuagcagaguauucuucgccuc gcugcugcaagccugaucugaagaagcugguauggauuguuucgcgacgcacugcgcagaaccuccacagcagcuacuacag uguuccugacugcccacuaucccagaggggguugcuuugacggaagugaaagugaggacucugguggaagacaugaguug uggagaggagagucucagcagcucccacccagcgaucaggagugcaccuucuucuuugacuuccaaguggcucagacacug ugcuuuccaccauagaggaaucugacauuguucugugucagggaauuuauaagugugugguaccuagguuucaaagcaauaa acuuggggguugaauagggguaguuuuccuagguuuccagccccccgucuagucagg | |
| Prc1/Protein regulator of cytokinesis 1 DNA segment, Chr 7 AA856349 | 3 | aacuaccuugggcagguucuauuaacugcaccuaacucagacg ugaguaggacagaaggaagcuguccgggcgaacugaggucac aaagacuugcuuuugauucaagagagaccuuaaaggcuaguua ugauaguuaaguacaaguuuuaaacaucuggguagcuaacuuuu uuucucuaccccguaauucuacuaugacugcucuucuagaggu ccugaguucaaaucccagcaaccacauggguggcucacaaccauc uauaaugggaucugaugcccucuucggugugc | 273 |

Thus, the transcripts identified in this Example, the proteins they encode, and the pathways in which the proteins participate, contribute significantly to induction of epidermal cells to differentiate into HF stein cells. Activation of the transcripts, proteins, and pathways depicted in Table 4 is thus a method for enhancing EDIHN. In addition, inhibition of the transcripts, proteins, and pathways depicted in Table 4 is thus a method for preventing EDIHN and eliminating hair follicles. In addition, inhibition of the transcripts, proteins, and pathways depicted in Table 5 is a method for enhancing EDIHN. In addition, activation of the transcripts, proteins, and pathways depicted in Table 5 is thus a method for enhancing EDIHN.

Example 10

Expression of Wnt-1 Inhibitors During the First Nine Days after Wounding Causes Pigmentation of New HF Materials and Experimental Methods In this Example, doubly transgenic mice expressing both tetO-Dkk1 and K5-rtTA were utilized. When these mice are fed chow formulated with 1 g/kg doxycycline (BioServ, Laurel, Md.), they express Dkk1, under the control of the K5 promoter, in the basal epidermis. The control mice also received doxycycline, but they were K5-rtTA negative and thus did not express Dkk1.

Results

Figure 23A:
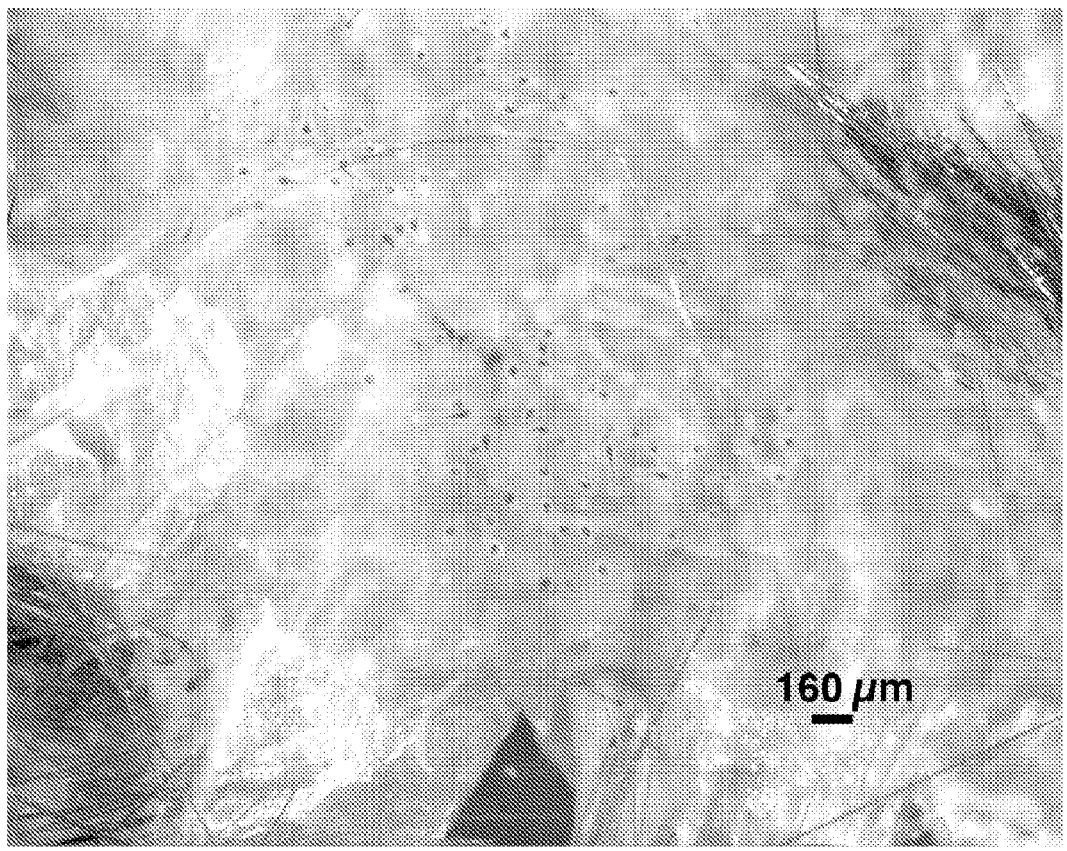
FIG. 23. Pigmented hair follicle neogenesis observed in the skin of Dkk1-expressing mice following EDIHN A. 3.2× magnification. B. 8× magnification.
Figure 23B:
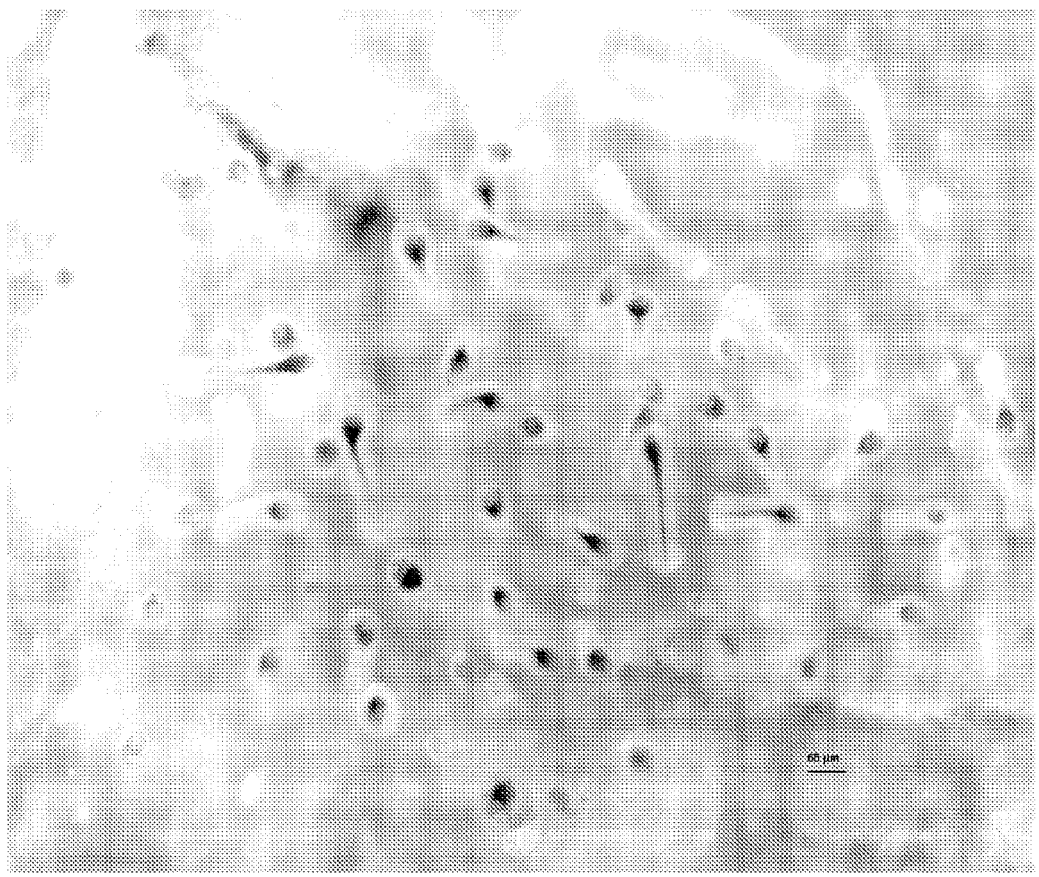
Figure 24:
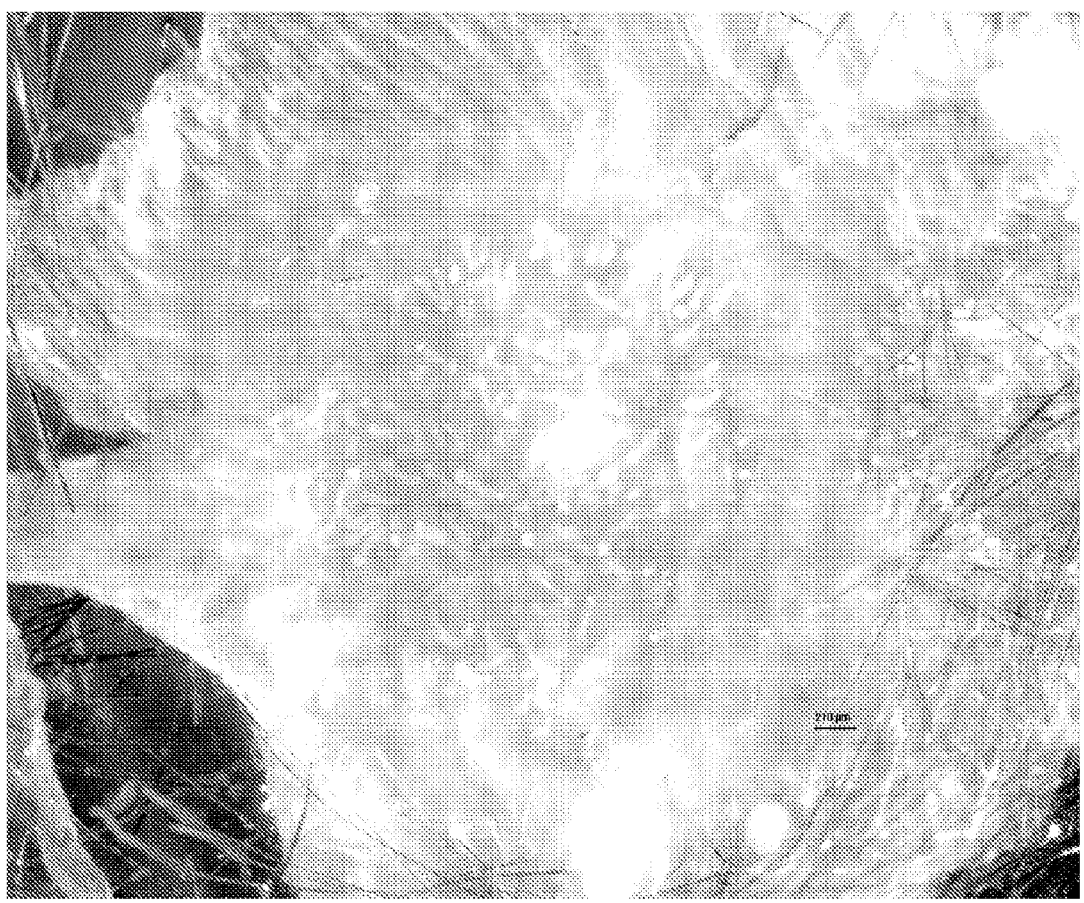
FIG. 24. Control mice lacked pigmented HF.
Figure 25A:
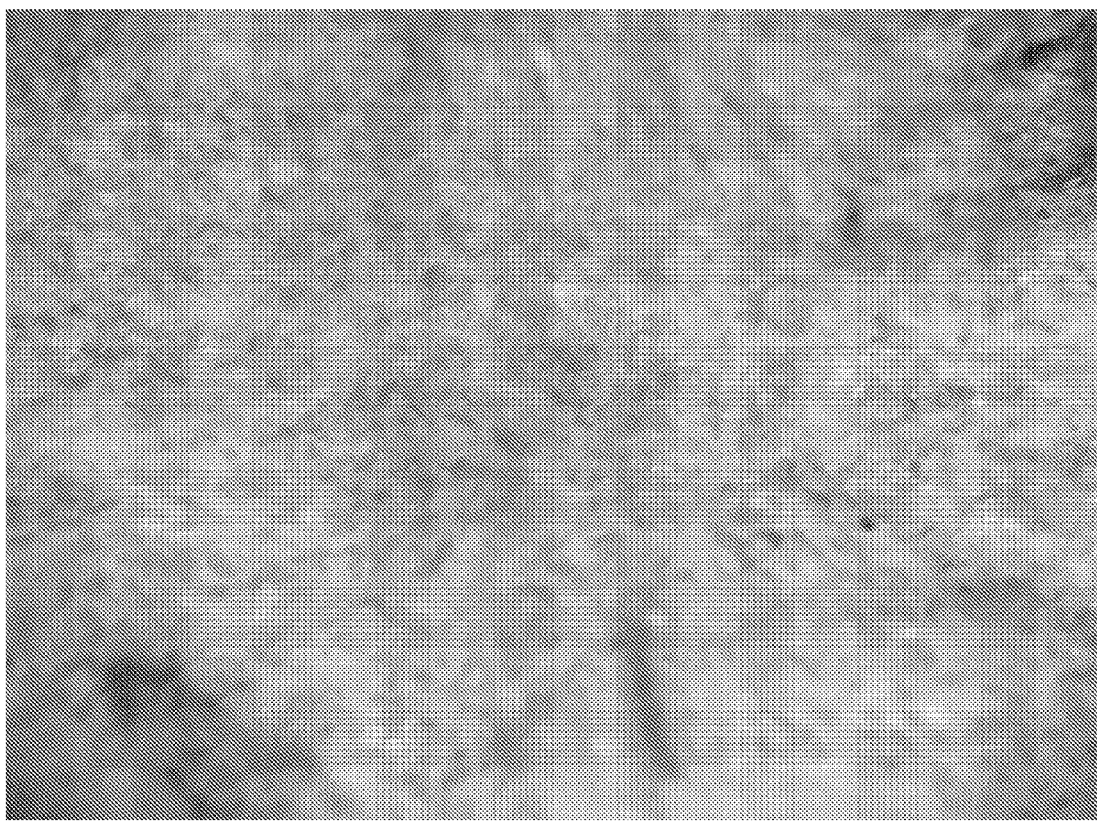
FIG. 25. EGF inhibits HF formation by EDIHN. A. K17 staining of wounded skin of representative mouse treated with EGF. Magnification is 4×. B. High magnification view (10×) of skin depicted in (A). C. K17 staining of wounded skin of representative control mouse that received no EGF after wounding. Magnification is 4×. D. Higher magnification view (10×) of skin depicted in (D).
Figure 25B:
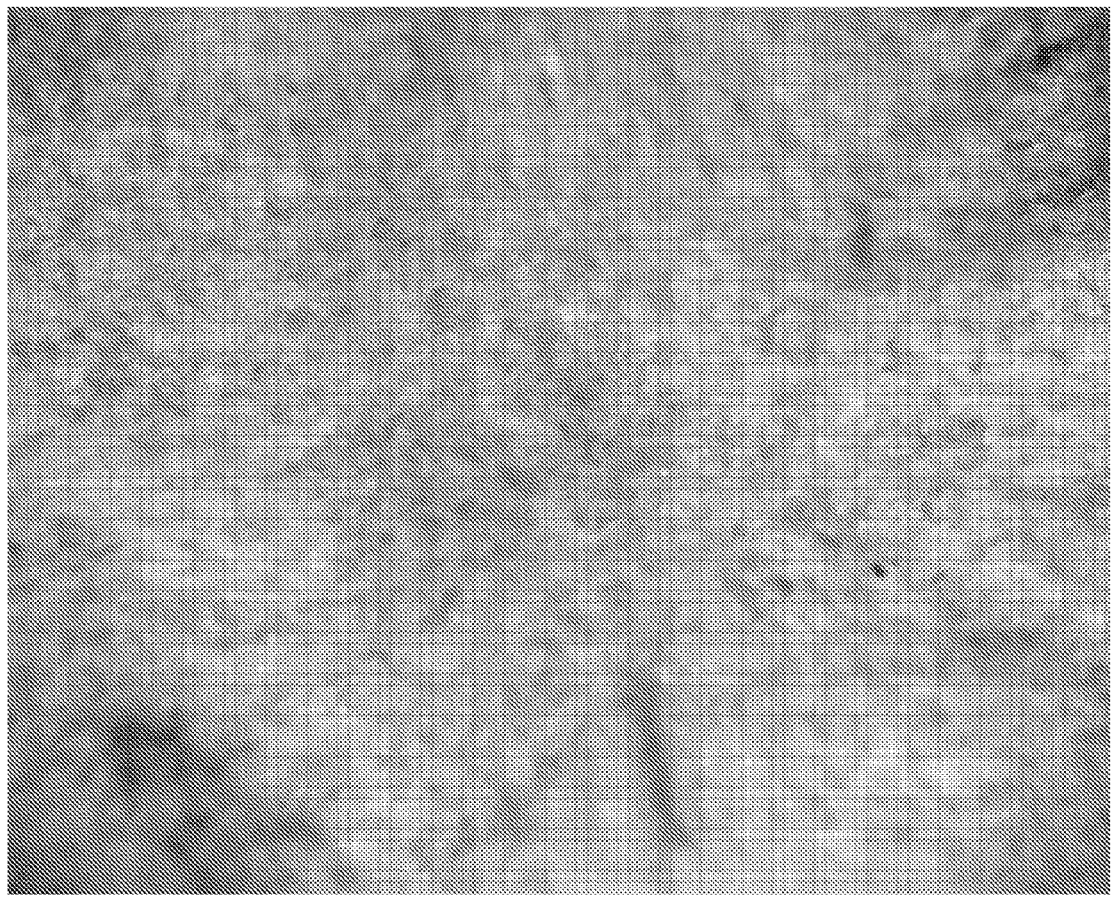
Figure 25C:
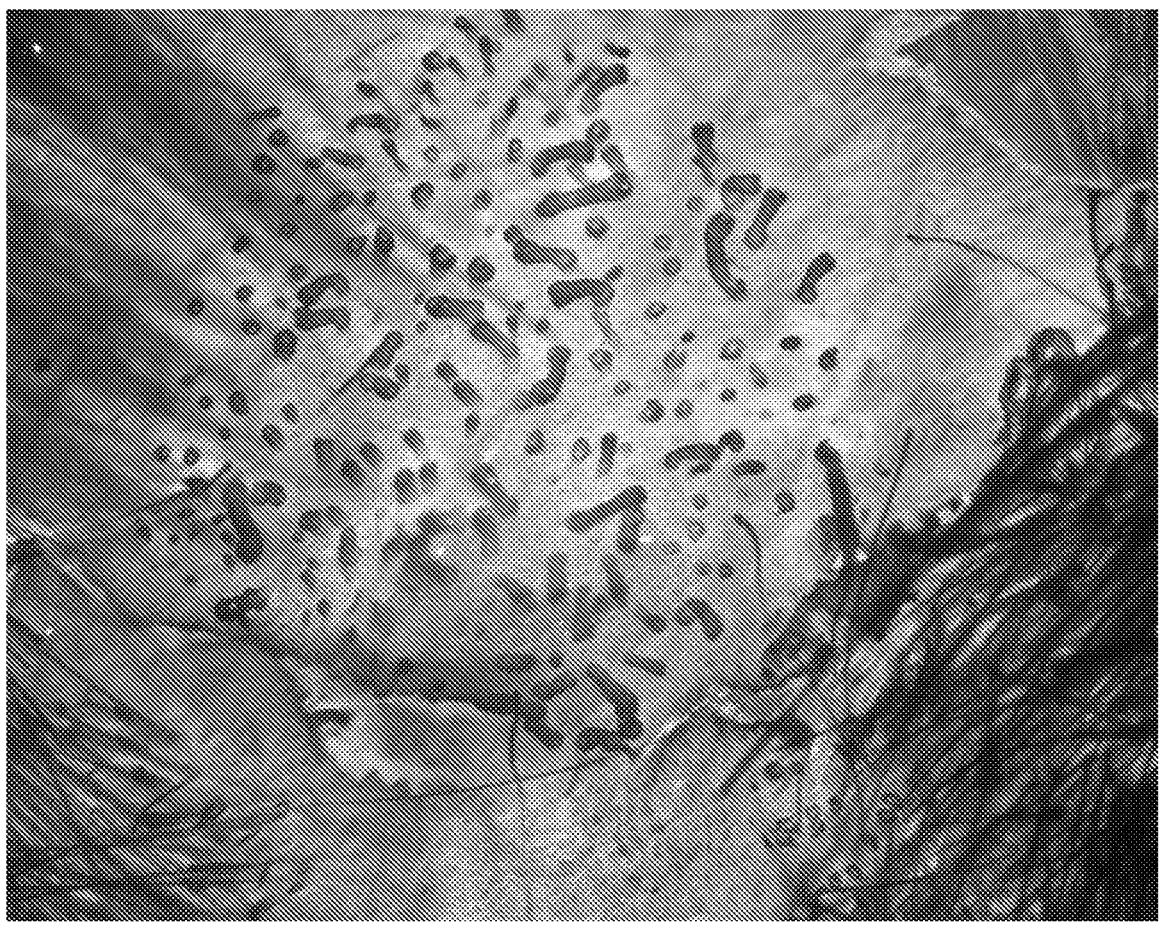
Figure 25D:
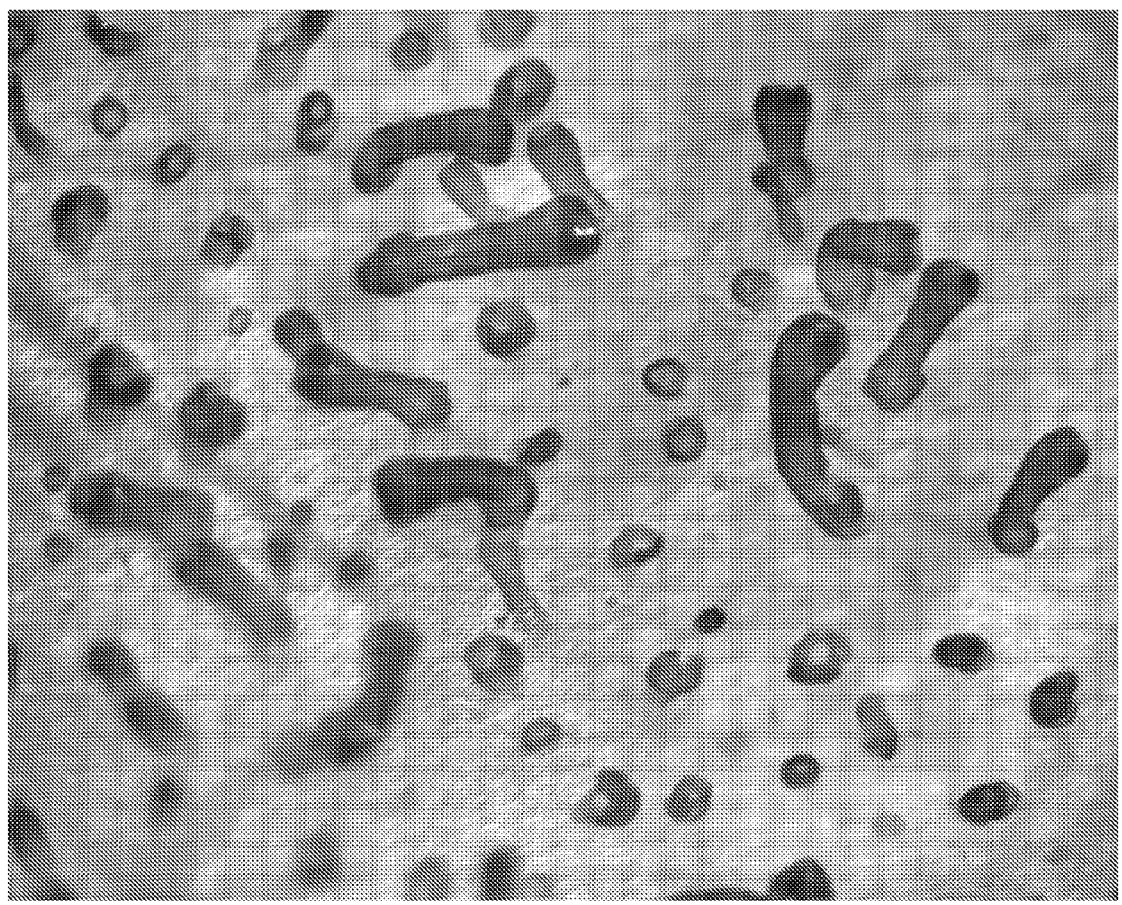

A 1 cm² wound was induced on the lower back of the doubly transgenic mice at 21 days or 50 days old. Mice were placed on doxycycline-containing chow immediately after wounding to induce Dkk1 expression, and then doxycycline was discontinued after completion of the re-epithelialization at 9 days after wounding. Dkk1 expression inhibits Wnt activity, which in turn induces follicle pigmentation. At 22 days after wounding, pigmented HF were observed in the excised skin after preparing the epidermal sheet (FIG. 23A-B). Control mice lacked pigmented HF (FIG. 24).

In other experiments, continued expression of Dkk1 after the 9-day period inhibited formation of new HF.

The findings of this Example show that pigmented HF can be produced by suppressing expression of Wnt1 or by inducing expression of Dkk1 during the period of re-epithelialization, then inducing expression of Wnt1. In addition, the findings of this Example show that factors that inhibit neonatal hair follicle formation (e.g. Dkk1) also inhibit EDIHN, thus further supporting the notion that hair follicles formed by EDIHN are similar to normal hair follicles.

Example 11

Inhibition of EDIHN by Epidermal Growth Factor Injection 21 day-old mice were wounded as described in previous Examples. Starting from day 11 after wounding, a time point corresponding to the point at which the wound had recently reepithelialized, 10 μL of 1 μg/ml EGF was injected into the wound bed. EGF was injected once per day after this point for a total of 5 days. Three days later, the skin was collected, and whole-mount EDIHN assays were performed. EGF prevented HF formation as assessed by gross morphology. In addition, whole mounts of control and treated skin were analyzed with anti-K17 antibody immunostaining. All mice injected with EGF (n=4) exhibited no new HF formation (FIGS. 25 A-B), while control mice (n=2) had many new HF, as expected. (FIGS. 25 C-D).

In an additional experiment, recombinant EGF (1 microgram (mcg)/microliter (mcl)) was injected at days 11, 13 and 15 after wounding. Skin was collected at 18 days after wounding and stained for K17 and alkaline phosphotase. Once again, administration of EGF inhibited EDIHN.

The findings of this Example show that EGF inhibits HF formation. Thus, inhibiting EGF, EGFR, or one of the pathways in which they participate increases EDIHN-induced HF formation.

Example 12

Enhancement of EDIHN by Inhibition of EGF Receptor

Figure 26A:
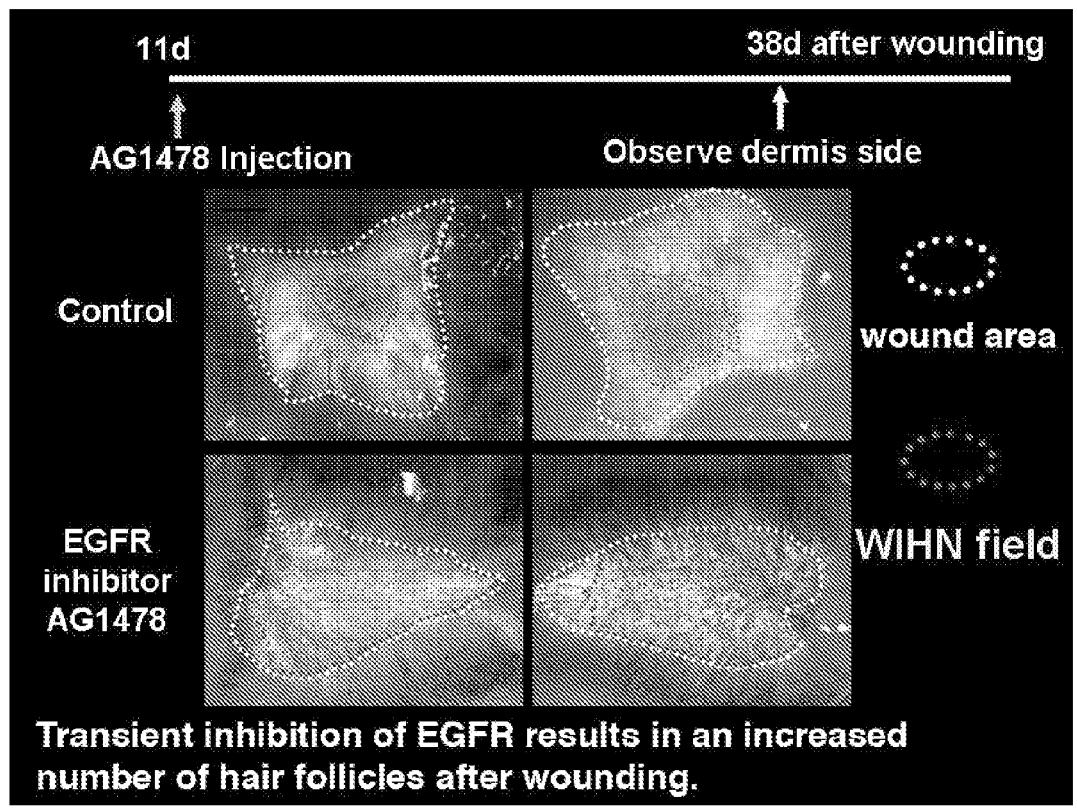
FIG. 26. Administration of an EGF receptor inhibitor (AG1478) leads to generation of more and larger HF compared with controls. A. Top: skin of 2 control mice. Outer dashed line indicates the extent of the wounded area after contraction and healing; inner dashed line indicates the area of neogenesis. Bottom: skin of 2 treated mice, in which the wounded area and area of neogenesis largely coincide, with the exception of a small area on the left side of the encircled area in each panel. B. Large hair follicles developed in the wounded area in the AG1478-injected mice. Left panel: epidermis stained for K17, with three large hair follicles next to each other. Right panel: dermis stained for AP with large coalescing DP areas. Scale Bars: 200 μm.
Figure 26B:
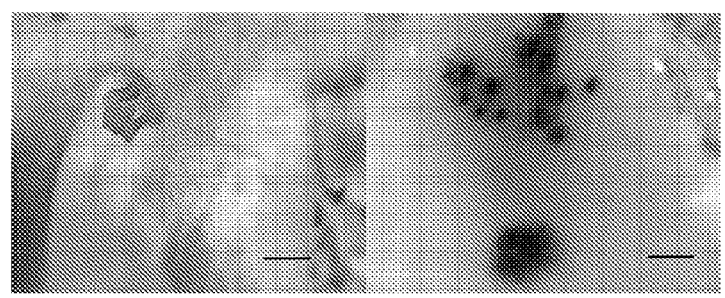

To determine the effect of administration of EGF receptor inhibitors on DIHN, the inhibitor AG1478 (150 μM in 10 μL volume) was administered as a single injection 11 days after incisional wounding (1 cm$^2$) to the middle of the wound near the skin surface. EGF receptor inhibitor administration led to generation of more and larger hair follicles compared with control mice that were wounded only (FIG. 26A). As shown in FIG. 26B, large hair follicles developed in the wounded area in the AG1478-injected mice. Left panel: epidermis stained for K17, with three large hair follicles next to each other. Right panel: dermis stained for AP with large coalescing dermal papilla areas.

The findings of this Example confirm the results of the previous Example, and show that more and larger HF can be generated when EDIHN comprises, or is followed by, administration of EGFR inhibitors, or with compounds with a similar mechanism of action; e.g. Hedgehog protein and androgen antagonists.

Example 13

Enhancement of EDIHN by Expression of a β-Catenin Activator

Figure 27A:
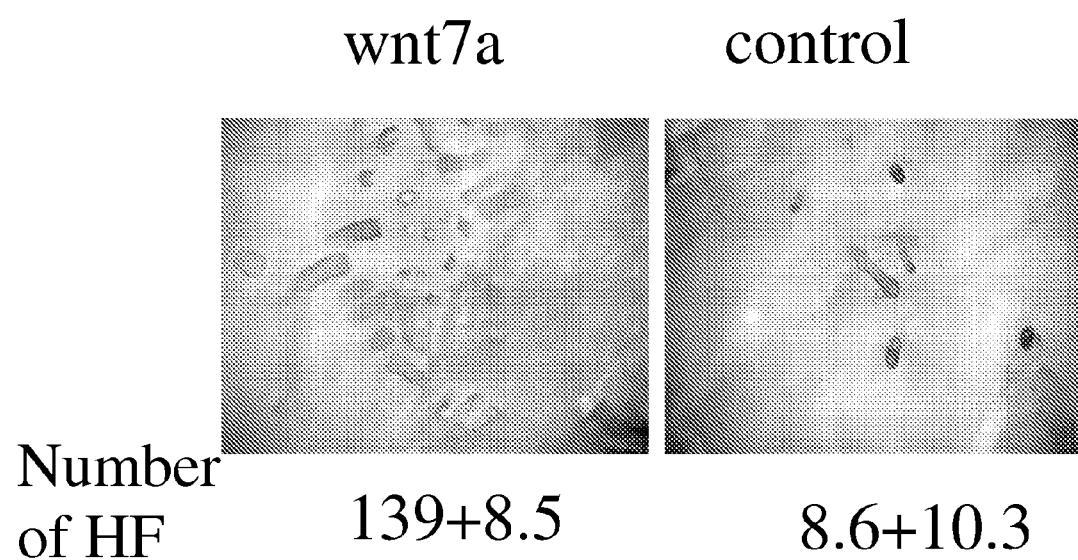
FIG. 27. A. Increased hair follicle formation in K14-Wnt7a mice. Left panel: Wnt7a transgenic mice. Right panel: control (wild-type) mice. B. Quantiation of experiment with 4 week old mice. C. Quantiation of experiment with 3 week old mice
Figure 27B:
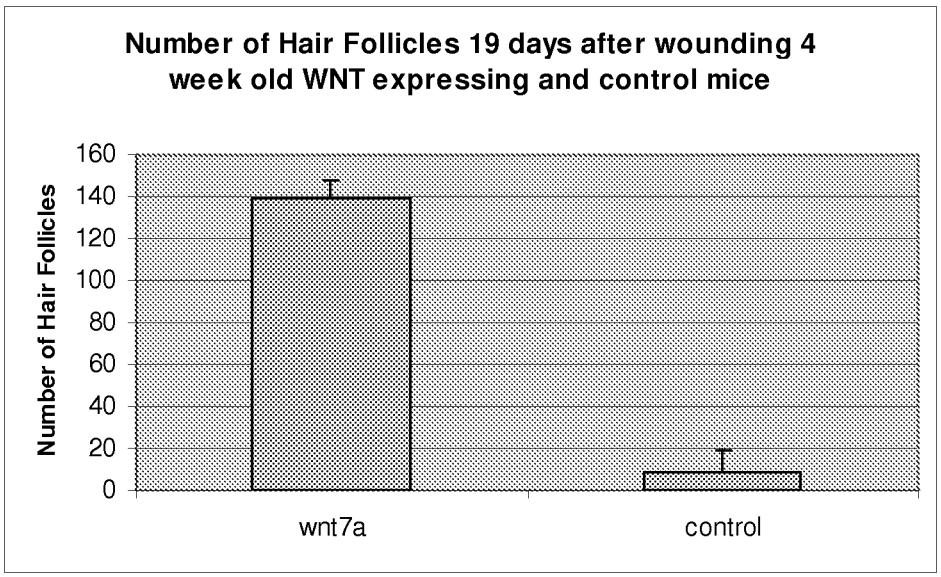
Figure 27C:
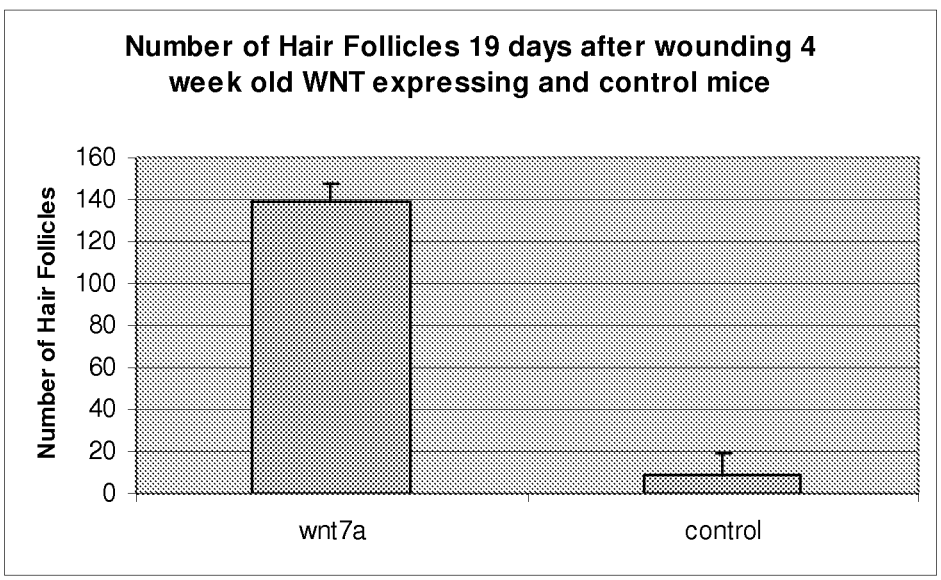

To determine the effect of administration of β-catenin activators on EDIHN, K14-Wnt7 transgenic mice, which overexpress the β-catenin pathway activator, Wnt7, in the epidermis, were subjected to EDIHN, then HF formation was measured 19 days after wounding. In each of 2 separate experiments, with 4 week old and 3 week old mice, the transgenic mice developed significantly larger numbers of HF compared to control, non-transgenic littermate mice (FIG. 27 A-C).

Thus, administration of β-catenin activators leads to an increase in EDIHN. The findings of Examples 11-13 show that new HF can be generated by (a) disrupting the epidermis; and (b) administering a factor that promotes a differentiation of an uncommitted epidermal cell into a HF cell.

Example 14

Enhancement of EDIHN by Administration of FGF

To determine the effect of fibroblast growth factor (FGF) on EDIHN, recombinant FGF is administered 11 days after incisional wounding, as described in Example 11. FGF administration enhances HF formation, showing that new HF can be generated by (a) disrupting the epidermis; and (b) administering FGF, a nucleotide encoding FGF, or a factor that increases signaling by FGF.

Example 15

Enhancement of EDIHN by Administration of EDAR

To determine the effect of fibroblast growth factor (FGF) on EDIHN, K14-Eda-A1 transgenic mice, which overexpress (ectodysplasin-A1) Eda-A1 in the epidermis, are subjected to EDIHN, then HF formation is measured 19 days after wounding as described in Example 13. The transgenic mice develope significantly larger numbers of HF compared to control, non-transgenic littermate mice, showing that new HF can be generated by (a) disrupting the epidermis; and (b) administering a factor that enhances signaling by ectodysplasin.

Example 16

Enhancement of EDIHN by Administration of Minoxidil

To determine the effect of minoxidil on EDIHN, recombinant FGF is administered 11 days after incisional wounding, as described in Example 11. Minoxidil administration enhances HF formation, showing that new HF can be generated by (a) disrupting the epidermis; and (b) administering aminoxidil.

Example 17

Removal of HF by Abrasion and Administration of EGF

Hair-bearing regions of the epidermis of mice is abraded, as described in Example 1, then administering recombinant EGF, as described in Example 1. This method prevents hair re-growth in the abraded areas, showing that hair can be removed by (a) disrupting the epidermal layer; and (b) administering EGF, a nucleotide encoding EGF, or a factor that increases signaling by EGF.

SEQUENCE LISTING (273 sequences)

SEQ ID NO: 1 - RNA, 321 nt, Homo sapiens
uuuuuuuuuuuuuuuuucuuaaaaauauaaauguauuugucugcaucaugacguucuucgggcaccuagcuggccagaccacuggccaugggacaaggaggaagucagguguaagucugagcaaggaacaggacucugcccuggcaggguggagguggccucacagugucccaugcugggccugguagcgugaaagcacagcacgguagugggacagcuccugccgcacagccaccaccuccugccgcaacagggcguuuuccuucuccaggaaggcagcccgcacagauauccgguucuccuugagucuucuugcaucuc

SEQ ID NO: 2 - RNA, 1580 nt, Homo sapiens
caguuccucagcauggccaccugcagccgccaguucaccuccuccagcuccaugaagggcuccuguggcaucggugguggcucuagccgcauguccuccauccuggcuggaggauccugccgggcucccagcaccugcgggggcaugucaguuaccuccucucgcuucuccucugggggagucugugggauuggagguggcuauggugggagcuucagcagcagcaguuuugguggaggacuugguaguggauuugguggucgauuugauggauuugguggugguuuuggugcuggucuuggugguggucuuggcggugguauuggugaugggcuccuggugggcagugagaaagugaccaugcagaaccucaaugaccgccuggccaccuaccuggacaaggugcgugcccuggaagaggccaacagagaccuggaggugaagauccgggacugguaccagaggcagcggcccacugagaucaaagacuacagccccuacuucaagaccauugaggaccugaagagcaagaucauuauugccacccaggagaaugcacaguucacuuugcagauugacaaugccaggcuggcagcugaugacuucaggaccaaguacgagaaugagcuguucuugcggcaguccguggagggugacaucaauggccugcgcaaggugcuagaugagcugacccuguccagagcugaccuggaaaugcagauugaaaaccucagagaagagcuggccuuccugaagaagaaccaugaggaggagaugcuugccuugaggggucagacugguggggacgucaauguggagauggacgcagcccccgguguggaccucagccgcauucugaaugagaugagggaccaguaugagcagauggcagagaagaaccgcagagauguggaggccugguuccugagaaagacugaggagcugaacaaagagguggccucuaacagugaucuaauccagagcaaccgcagcgagguggcugagcuccgcaggguguuccagggccuggagauugaacugcagucccagcucagcaugaaagcauccuuggagaacagccuagaagagaccaaaggcagauacuguaugcagcugucccagauccaggguuugaucagcaguguggaggagcagcuggcucagcuucgcugcgagauggagcagcagagccaggaguacaacaucuuguuggaugugaagacaaggcuggagcaggagaucgccaccuaccgccgucugcuggauggcgagaauauccacuccuccucacagcacuccucuggacaguccuauucuucucgagaagucuucuccucauccucccgccagccccgguccauccucaaggagcaagguucaaccagcuucagccagagccaaagucagaguuccagggacuaauguuuugccuagagccuccucacccacaacugccucucaagcugagggcuuggggcaggacccuguuuucuuugcgcauuccccaucugucuccccuacccucucauggugguaggcuaauaaagcuuuuugguugaugcaaaaaaaaaaaaaaaaaa

SEQ ID NO: 3 - RNA, 1357 nt, Homo sapiens
gcgccaguccuccgauagacugagucgcccggguacccguguucucaauaaagccucuugcuguuugcauccgaaucguggucucgcugguccuugagagggucuccucagauugauugacuacccacgucgggggucuuucauuuggaggccccagcgagauuuggagaccccugcccagggaccaccgaccccccgucgggagguaagcuggccagcggucguuucgugucugucucugucuucgugcguguuugugccggcauuuaauguuugcgccugcgucuguacuaguuagcuaacuagaucuguaucuggcgguuccgcggaagaacugacgaguucguauucccggccgcagccccugggagacgucccagcggccucgggggcccguuuuguggcccauucuguaucaguaaccacccgagucggacuuuuuggagcuccgccacuguacguggcuuuguugggggacgagagacagagacacuucccgcccccgucugaauuuuugcuuucgguuuuacgccgaaaccgcgccgcgcgucugauuuguuuguuguucuuuuguucuucguuaguuuucuucugucuuuaaguguuuuucgagaucaugggacagaccguaacuaccccucugaguuuaaccuugcagcacuggggagauguccagcgcauugcauccaaccagucuguggaugucaagaagaggcgcuggauuaccuucuguuccgcugaauggccaacuuucaaugugggauggccucaggaugguacuuucaauuuaaguauuaucucucagguuaagucuagaguguuuuguccugguccccacggacacccggaucaggucccauauaucgucaccugggaggcacuugccuaugaccccccuccgugggucaaaccguuugugucuccuaaacuuccucccucgccgacagcucccguccucccgcccgguccuucugcgcaaccuccgucccgaucugcccuuuacccugcccuuacccccucuauaaaguccaaaccuccuaagccccagguucucccugauagcggcggaccccucauugaccuucucacagaggaccucccgccguacggagcacaaccuuccuccucugccagagagaacgauaaagaagaggcggccaccaccuccgagguuucccccccuucucccauggugucucgacugcggggaaggagagacccucccgcagcggacuccaucaucucccaggcauucccacuccgcauggggggagauggccagcuucaguacuggccguuuuccuccucugauuuaacccuuccuuuucugaagauccagguaaauugacggccuuga

SEQ ID NO: 4 - RNA, 463 nt, Homo sapiens
gacguagagccccuugcgcccgguuuccugaucccgcuuacuccucugcgcgccggcaggauggcccacaagcagaucuacuacucagacaaguacuucgaugagcacuacgaguaccggcaugucauguuacccagagaacucucuaaacaaguacccaaaacucaucugauguccgaagaggaguggaggagacuugguguccaacagagucuaggauggguucauuacaugauucaugagccagaaccgcauauucuucucuuuagacgaccucuuccaaaagaacaacaaaaaugaagugcagcugggaucaucuaaucuuuuucaaauuuaauguauauguguauauaagguaguauucagugaauacuugaaaaguguacaaaccuuucauccauaccugugcaugcgcuguauucuucacagcaacagagcucagucaaaugcaacugcaaguagg

SEQ ID NO: 5 - RNA, 1973 nt, Homo sapiens
  misc_feature (558)..(558): n is a, c, g, or u
  misc_feature (569)..(569): n is a, c, g, or u
auuaaaaagccagcugcccaaugccugcacacagaauccacaccaacagagaaccugcucuucucugaguauuagguaagucucugcuugcaacugauuugaaauucuugcuuauuuuuuuacuaugaaaaacuguucaaagccaacucuauuacagaguugauguggggugcugccuacaguuagugaacaguagcauuguuugcuuaaauuauagcacauuuugggucuaggaacuugagaggugauucaguuggucacuguaguagacagccuuggaaucagagauuaaggcaaaaggaaaccuccauucaaauauucauggaaguucacagcuggagacagguuaaggcuucaguccagauagcuuucagaauuauugcaguucuuacugauaggcauaucaauagcgaaauuuaauuuauuagaggaaucuacuaaaguaaauuuuuaggccaauauagaacauaccauacuuguagucuggcagagaaggugacauaugaaauugaaaugcgauucauagacagugguagugaaagaaauaaugguggggangggcugugcangggaggcauggcucaaggacagcacuuagugguagcacacaccaugaacuaugauggaaaagcauuugauaggcagagacagaaauguaggaaauguguagggauccaugagagcauaaacuaaaagggcaaaagcauaugagcauggacuaacaugcagccacucugcaaguuauacuaugaucuauuucacaaggagguugguaugcugcugucuuugggugacaccgcuuucccagauguccugguguguagguucacaagccucucagaagccauacuuuauugcuuuuuaagacguauuauuaauauuuuggcuagcauaugguuuagugugagaguuuuauaugcauaugucauuauacuuugcucauuuaugucuuggaacuucuucaacuagguagaaaacaugaccagggagaaugagaguaaggaaagaacccacugagacagacaagagcaaaccauacuucugcuaaucauguuuaaaaguccagaaaugaucauaccauauuuuauuuucaaguguggaagucagcauggagaggggcucuuuuucucuaaaggggccugaaauuaaauugacuugauguugagguuaccuucucuuucaaugaaucacuaaauugucuuuucuguuucccaggacccaagugcuaucuaaccaugaguucccaccagcagaagcagcccugcacuguaccuccucagcugcaccagcagcaggugaagcagccuugccagccaccaccccaggaaccuugugcccccaaaaccaaggaucccugccacccuguuccugagcccugcaaccccaaggggccagagcccugccaccccaaggcacccgagcccugccaccccaaggcaccugagcccugcaaccccaaggugccagagcccugccagccuaaggugccagagcccugccagccuaaggugccagagcccugcaaccccaaggugccagagcccugccaaccuaaggcaccagagccuugccaccccaaggcgccugagcccugccacccuguuguucccgagcccugccccucaacugucacuccaucaccauaccagcagaagacaaagcagaaguaauauuguccagagccaugccugaagaccugaucaccagaugcugaggcugcugucuauccugcuuaugagucccauugccuugugcuaccaaugcugugaccuucagucuuaaucccucucuccuugcaccaccuaaaaaguugacucucauccucaucuucaagggcuccugagccucuuaacauugcccaaagucauauugaauggcuacacuuuucauggcucaggauucaucugaagggggugaggagugagacaaguguauggucaauauuuuccccccauuaaaugccauuuaacucc

SEQ ID NO: 6 - RNA, 254 nt, Homo sapiens
uuuuuuuuuuuuuuuuuagccaaaauaguuauuuauuaauaauuuaagguuuuacauucuuauaauaaauuccagcucaaaacuuuacaccacgaacaucauggagcaaguuaauucucccuuccucucaaccuguugcauccaccaaaugggcgcucauacucgcacacauacacacacuuccaguuucguauuuuuuuuuaaaaggaaagaaaccaacccaaaguauugcauuugaggugacacucccugaa

SEQ ID NO: 7 - RNA, 137 nt, Homo sapiens
aagaugcccuuuggauuggauuggauugaucauguuuaacucagcguauuuuauggaugaaagcuaaauacagauauuuggcaucucuaagguggaaugagcccacuccacacacugauaaaauucaugcauaguuu

SEQ ID NO: 8 - RNA, 622 nt, Homo sapiens
  misc_feature (27)..(27): n is a, c, g, or u
  misc_feature (30)..(30): n is a, c, g, or u
  misc_feature (133)..(133): n is a, c, g, or u
aaccaaaugggaaugggguccccaacnuuncugugguaccagccggguuucucuugcauuggaaacaaacaccuuuguaggcauuugcguauucgugaagagacuguuuuaugaaucaccucuuagauuuaunuaauuaaccuaaguuguugaaguuucuguuucuccuuaagagaaauuacaaaaauucaacauugaagcauaguuucuuguuuucuguugucaaauaguaauaaugugcugugauguuuaugcuuauucauaaagauguuuuacuuuuuaguguaauguuaguucuuuuuaacauuauuuugcuuaaauuugauaaugcccgacaagaauauauuuugcuuugauuuauacacugauucuuugugacaaauaugacccauuaaaaaugccuuuuaauagacuaacuuaccuuuuguagcuagguacucauguucuuuuuuaaaagaugcccuuuggauuggauuggauugaucauguuuaacucagcguauuuuauggaugaaagcuaaauacagauauuuggcaucucuaagguggaaugagcccacuccacacacugauaaaauucaugcauaguuuuaaaugaacauuaauaaacucauguugucuu

SEQ ID NO: 9 - RNA, 613 nt, Homo sapiens
gaauucaaggaggcuuuccagcuguuugaccgaacaggugauggcaagauccuguacagccaguguggggaugugaugcgggcccugggccagaacccuaccaacgccgaggugcucaagguucuaggaacccccaagagugaugagaugaaugugaagguacuggacuuugagcacuuccugcccaugcugcagaccguggcgaagaacaaggcccagggaaccuacgaggauuauguugaaggccuucguguguuugacaaggaaggaaauggcaccgucaugggugcugaaauccgucauguccuagucacacugggcgagaagaugacagaggaagaaguagagaugcuaguggcagggcaugaggacagcaaugguugcaucaacuaugaagcauuugugaggcauauccugucggggugacgggcccgauggggcggagcucguccggauggugcugaauggcugagacauucuguaucccgagucuguucccugcccagugugauuucuguguggcuccagacgcuccccugucacagcaccuugucccauuugguuucuuuggaugauguuugccuucaccaaauaaaauuugcucucuuugccc

SEQ ID NO: 10 - RNA, 1508 nt, Homo sapiens
caaccaccuccuaccugccugcccaaagcuccagggcuggagcacggagaccugucagggauggauuuugcccacauguaccaaguguacaaguccaggcggggaauaaaacggagcgaagacagcaaggaaacuuacaaacugccgcaccggcugauugagaaaaagagacgugaccggauuaacgagugcauugcccagcugaaggaucuccuacccgaacaucucaaacuuacuacuuugggucacuuggaaaaagcagugguucuggagcuuacguugaagcacgugaaagcauugacaaaucuaauugaucagcagcagcagaaaaucauugcccugcagagcgguuuacaagcuggugauuugucgggaagaaaucucgaggcagggcaagaaauguucugcucagguuuccagacuugugcccgugagguacuucaguaccuggcgaagcaugagaacacucgggaccugaaaucuucccagcucgucacucaucuccaucguguggucucggagcugcugcaggguggugcuuccaggaaaccauuggacucggcucccaaagccgucgacuugaaagagaagcccagcuuccuagccaagggaucagaaggcccagggaaaaacugugugccagucauccagcggacuuuugcucccucggguggggagcagagcggcagugacacggacacagacaguggcuauggaggugaauuggagaaaggggacuugcgcagugaacagccguacuucaaaagcgaccauggacgcagguucgccgugggagaacgugucagcacaauuaagcaagaauccgaagagccccccaccacaaagagccgaaugcagcucucagaagaggaaggccacuucgcgggcagugaucugauggguuccccauuucuugggccacacccacaucagccuccuuuuugccuucccuucuaucucaucccaccaucggccacugccuaccugccuaugcuggagaaaugcugguaccccaccucugugccaguguuauacccaggccucaacaccucagcugcagcccucuccagcuucaugaacccagacaagauaccgacucccuugcuucugccccagagacucccuucuccuuuggcacauucgucccuugacucuucggccuugcuccaggcuuugaagcagaucccuccuuuaaacuuagaaaccaaagacuaaacucuggagggaucuccugcugccuugcuuucuuuccucccuaauuccaaaaaccacgaagguuucccugagugcagagagaucagcccacccugcagacccacagagaagauucagagugugugugagagugagugagugugcgugcgugcgugcuuguauguauguuuguauauguaggacaauaaguuccuucugacacaagggagacacgagaaggauagccugacaucagaugacagacuggaggacuguagcacaucucugggcguuucccuacccagagaagagcc

SEQ ID NO: 11 - RNA, 3660 nt, Homo sapiens
uugcaggcgagggcuuccacaacuaccaccacaccuuccccuucgacuacucugccagugaguaccgcuggcacaucaacuucaccacguucuucaucgacugcauggcugcccugggccuggcuuacgaccggaagaaaguuucuaaggcuacugucuuagccaggauuaagagaacuggagacgggagucacaagaguagcugagcuuugggcuucugaguuccuguuucaaacguuuucuggcagagauuuaauauucuguugauuaacuaacaacuggauauugcuaucgggguguuaaugaugcauuuaaccuauuccgguacaguauucuuauaaaaugagaaagcuuugaucacguuuugagguaauaaauauuuuauuuagcuaggauuaaccaugccacaagacauuauauauuucuaagcacacaugauaaaugcauauacaauuuugcacaacagcuuuaaauaauaacaauaaauuugaacauucuauacagagaggaucaaagccaaggaacaugcuguuuugaugcuagggugagcauggugcucagucccuguuuguuugcaugguguccagcuuuguuucuucucugucaucaccaccuucaggcaaauaguugaccaaccacuggccugugucuguccacccuccaaagcccaggccaccuuucuguuuucugaaauacugauccuuccuccugaauacaucccuccuuguuccuagcuucaagacugcugccucaaauagggauagagcaaguccccgcugcagguugugcuagaugggauggagaaauuaucuucauuugauacagagcaaguagauugucucgagagaaaaguuagcaugcgugguaugauuuguaaguaaagauggaagagagagagagagagagagagagagagagagagagagagagagagguagccauaucuaacagccuacuuaccaaagaccccaggccucucugcuuggcaugccuccuuucuguccauccucugaaccccagagauuagugagauuugaauaauuaaaucauuuucagagugaaggggguuaaugcagggucugugcuaggggaggguuuuagcuuuugguaacugaagauuuuuucauggaaaaagucuucguguucaaugugccuagaacugauaacuaaacagcugacauuugucggggacagauauggugugaaacuaugaaaauauaagcaaaaucuucacuuggaacaugaaacuauuucacuuagaaaauaaucgaaggacccgagguguugccuggguugccaguuucuuucguggcugggcaggaacuagugagguugaggggcagugucuguaaguagcugcuaagaggugcauuuccagaugaagcccuuggggaacaucugccagggauccgcaugguguuggcuccauccauugcuuuaguuuccuccuuggauuguguagaaacuuggcuucccaugguuuugaaccuuccaugccuucuuugcuuuguggccacccagccugccuagugcugccuaggaagcucuuacccaccugauuucuucugacauuucuuucuuuggccuuuuuuucuuucuccggacaugcagcuaguugccugaguguaucaagagcacccaggacuugcugcuguccaggccuguuccucccccaguauccguggguguggaagagcuguguagcuucaggaagcagagccaggugccaccuuucuguggcuuccagauccucccuaccuccaacucaugugccucugucacagugauuucaggaaagcuugguagacccucuagcaacaucucgguucagaaagucucucugguuugugaguuaacagcucagcuaagugcuguuuugucucagugaguuaaccacugaaugcgaggguugguuguugaucugucucggugugugucggaguagacagcauaugcacuucucccugugcgcuuugcaagguaauguggcuuuggcugauccaugcaggcagguagugguacagugcugcugaaaggaagaaguuccccauuuuaucuguuaaaacaccagagacaugggcaagugcuaauggaccucacuucaggaagagggucugcuuccugaagccagugugugaugaaaagugacugagaccugauaucuaaggugagaccugauaccuaacacucugucacacaguccagggccaacagugcuauaggaaagucuagaagaaaacaucacaucaguauuuuagaaccaucaaccaucucuugucccuauagcccaauccagaggccugguuuuuagaacuggcuguguaaggugccaaacacucaguucacuuguagaaucagagccuuuuuuccccccuauguuaauugaacacgcgcucugagcuguuuuguugaaguagaaaaucucauagaaaaaucacuguagaucuacugaccuauagcccucuggaaaugccuuugagaugguuuuacuuuucuaggucauagaugccugauuauaaagaugaacaauaaaaucagcuuucuuucuuucucuucugaucuuauuccccagaucugauucaggccauguuccaaagcaaggcuacauugagguccuggugucuuuaaguaaaggacaucuuucagauccucucaaagaaggauuuauaacaguuuccagaugaauguacuaauagcuuugggugccuuaucucuuuccuaaucuguagugccugugagcucagucucacuccuucccuuagcccggagaccccuuagaucgagugggaauagucaagaggcuggcuggagagucaucaguacauugguuugcagaaaucuuuuacaggcuacauuuuggaauuuuuuuuuuuuuaguaagugaucaaauuuggugggaaguaauucgaguguauucgauuguauugucguccucguuaucauugucaaacauguuauagacggcaguuggcacuggggcugcuaaucucuggguguagucucugaaacuguagcuccagugagguggugugaaagguuagcaaagccaccaucugcuggugcuccagccaaggugccucuuagccacugaauugcuauguuauccuuucucuuguaacaaacccaccccagagauaaagccuuuaaucaacccaagaaacuccugggcuaaguaucugacagucucacaucucaacagugugaauuaaguguccauagcaucagcucaggaggacacucugggagagugcugacaaaaaaggguuauuaauacugaccuacuacuucaagggcaguucugaggugauuagagcuuuuuuuaaaaaccaaguauuuggggauccucagcagagguauucauacagacucccaaagaacuauauauguuccugagaccaucguuuagucuacauugcucuucccagagacugacagauaugaccagucaaagugcaagacuaccuacccacugccaugaaaaccauugcaggaaaccuuucccuuccugaaugagauuuuuuuuuucccuuuuuaugugggguaauuauuugugacccaaguguaauuuggaugauuuccauuaauaucaacucuugaagccuacuuguacugauugagauuguauuuguuccuaauaaaaguggaucugguuguacuguc

SEQ ID NO: 12 - RNA, 429 nt, Homo sapiens
accacuugcagacaaaugaauuccuucgaaauguauuugagguuggacccccugugaugcuugaugcugcaacacuuaaaaccaugaagauuucucguuuugaaaggcauuuauauaacucugcagcuuucaaagcucgaacaaaagcucgaagcaaaugccgagauaagagagcagauguuggagaauucuuguagaugucugaauuugauggcuguuuucuaaucucuuccuuuauuauuauuuuugcuacuucuaauguauauaagcuuuuagagacaguuuuuuaucuuggucaacuuaaauaauuuuugauguagggguggguuguauuuuaauuuaauguacaguguuacaaauuaaugaguucuuuauucucuguaaaaauaacugguaaccacaaauaaaguguuugugauguuuggucgu

SEQ ID NO: 13 - RNA, 1639 nt, Homo sapiens
  misc_feature (1003)..(1003): n is a, c, g, or u
  misc_feature (1098)..(1099): n is a, c, g, or u
  misc_feature (1106)..(1106): n is a, c, g, or u
  misc_feature (1112)..(1112): n is a, c, g, or u
  misc_feature (1158)..(1158): n is a, c, g, or u
  misc_feature (1161)..(1161): n is a, c, g, or u
  misc_feature (1171)..(1171): n is a, c, g, or u
  misc_feature (1182)..(1182): n is a, c, g, or u
  misc_feature (1245)..(1245): n is a, c, g, or u
  misc_feature (1436)..(1436): n is a, c, g, or u
  misc_feature (1472)..(1473): n is a, c, g, or u
auguccgcggccgccuacauggacuucguggcugcccagugucugguuuccaucuccaaccgcgccgccgugccggagcacgggggcgcuccggaagccgagcggcugcgacuaccugagcgcgaggugaccaaggaacacggugacccgggggacaccuggaaggauuauugcacgcuggucacuaucgccaagagcuuguuggaccucaacaaauaccgacccauccagacccccucggugugcagcgacagucuggagagucccgaugaggauauaggauccgacagcgacgugaccaccgaaucugggucgaguccuucccacagcccggaggagagacaggauucuggcagcgcgcccagcccacucucccuccuccacucuggaguggcuucgaaggggaaacacgccuccgaaaagaggcacaagugccccuacaguggcugugggaaagucuauggaaaauccucccaucuuaaagcccauuacagagugcauacaggugaacggcccuuucccugcacguggccagacugccuuaaaaaguucucgcgcucggaugagcugacccgccacuaccggacccacacuggggaaaagcaguuccguugcccacugugugagaagagauucaugaggagugaccaucucaccaagcaugcccggcgucacaccguguuccaucccagcaugaucaagagaucaaaaaaggcucuugccugccccuugugaggugcuccccauggcagccaggcagagauggguccccggaaggacagagcucccaggaaacagacugacacauggaaaucugccacagcagaggcgcgcuggccacaggaggucacugcuucuuuggccaauauucugauaucucccugcacuguuuccaaaaagcacaugguagcccuaaggucaaagucaacauuugguccccuugcagaggcaacucugaaccgucucugacugaagauucagacuggugguguacauacgucunacugggugaguugaccccuggccucccacagugcagaaccacucucuugaaucacauuaacuuuugagauuuaaaaaaaacccaaacccaacccnncaaaacnccaganacaccgaaacucuggauccucgaugcuugcugacucucagaauugnuunuucuucucanuuaugcaagcnagagcacaccuacuccagcaugauuugucaucuaaagacuugaaaacaaaacaacaacaacanaaaguuacuuauagucaauggauaagcagaguccgaauuuacacuaaucaagacagaccuucgaggggucacgauaaguccggaacuuucaaaccuugcuucguaugaauuguacuaucugaacauaaacugcacuuuuauuuucuaauaccgagggugaauacgguaaauacaugcuuugaggguagaanccgacggucuguuuggcaccacguuauaaucugcunnuuuuaacgaguaccaccuuggagggcaggcaaauaaaugcuuuuggguauuuucuccuuuguuuuugacaaaugcugcggaugggggaucgggaucggaggggagugcuuuuaaagauaauaaaaaaugagguaaauaauuuuaacuuaugaauuuguuugaauuc

SEQ ID NO: 14 - RNA, 1929 nt, Homo sapiens
gagauugaaacaauggaagaacuuuccauggcaaacaccauguuugcccucaaucuccuuaagcagauagaaaaaucaaacucuacccagaacaucuuuaucucuccauggagcaucucaucaacauuggccauaguucuccucggugcuggggguaacacugaacagcagauggccaaagugcugcaguuuaaugaaauuggcaguuaugguaucaccacaagaaacccagagaacuucaguggcugugauuucgcacaacagauacagaaggaaaauuauccuagugcuauuuuacaggcacaagcaggagauaaaauccauucagccuucuccucucucagcucaacaaucaacacaccacagggggauuauuuguuagaaagugcaaacaagcuguuuggagagaagucugcaagauucaaagaagaauacauccaacucucuaagaaauauuacucaacagaaccagaagcaguggacuuccuugaaugugcugaagaagcuagggaaaagauuaauucuugggucaagacucaaaccaaaggugaaaucccaaaccugcuacccgaagguucuguagaugaagacaccaagauggugcuggugaaugcugucuacuucaaaggaaaguggaaaacuccauuugagaagaaacuuaaugggcuuuauccuuuccgugugaacucgcaugagagcauaccuguccagaugauguuccuccaugcaaagcugaacauuggauacauaaaggaccugaagacucagauccuagaacuuccgcauacuggaaacaucagcaugcuccuguugcuucccgaugagauugaggacgcauccacuggcuuggaauugcuggaaagugaaauaaacuuugccaacuucaacaaguggaucagcaaagacacacuggaugaagaugauguuguggucuacauucccaaguucaaacuggcacaaagcuacgaacucaaguccauucuucaaagcaugggcauggaggaugccuucaacaagggcaaggccaacuucucaggaaugucugagaggaaugaccuuuuucuuucugagguguuccaucaagccagcguggaugucaccgaggagggcacuguggcagcuggugggacuggggcaguuaugacaggaagaacuggccaugguggcccacaguuuguggccgaucaucccuuucuuuucuuuaucauggacaaaauuacccacacgauacuauuuguugguagauucuccucacccuaaaaggggaagaccuauuuccacaugagguuuuguagcaugaacuauaagccucagaauugcaucuucaagugccaaaaguuuaaauacuuucuuacacauuuuuauacuucugcuauacacuaaauauaaccuaaaagcaauuguauagcagucuucagugcuuacaguauaacucuauuaaugauuuuguuuccuaaagucagaugaugucuauuuaguucauccuuauuacugcuuugucuuuauaacuuuaguuuuuacaguguuauuuauuguuuauauaaugguuguuuuacaaauuguuguccucuguuuaaugaaacuguaacacuacagaagcagaaaauuagauaauuuucuauuuaaagaaaaucagccauuuaauuuaauaaugaaggaaaaauaugagucuuccauacuuucccaugauauucacccagaaaaaauguacuuaacaaaagacauguuauaucucuaucauuauauaucauauguacguaucugcaacucaucuauaauuaggacuacaucauaaguaagcaugcuuacuuacacacugcuaucuguuguauaaaacuuagcaauccuuauuuguuaguuaucuuucuaucacuguaacaaaauaccugagauaauaaaguucaaagauuuauuuugaaaaaaaaaaaa

SEQ ID NO: 15 - RNA, 284 nt, Homo sapiens
  misc_feature (16)..(16): n is a, c, g, or u
uuuuuuuuuuuuuuunuaagaauuaacuuuuauuuuugcuuaguuuuauuaaaaaaauaaauaugucauaaagcuuuuguuuccuuuagggagaaaaaaaaggaacaaguuccauaaaaucaaacaagcaaugguaacaugucuuaacuugaaaacaacuggggucacugguuuacaaguuauaacugaaugaaugacugccacaguugcccauuuccuccugccaauggcagcaaacaacaggaucaacuagggcaaaauaaauaauuguguggaagcccuga

SEQ ID NO: 16 - RNA, 219 nt, Homo sapiens
  misc_feature (70)..(70): n is a, c, g, or u
  misc_feature (88)..(88): n is a, c, g, or u
  misc_feature (132)..(132): n is a, c, g, or u
  misc_feature (205)..(205): n is a, c, g, or u
aacuaaacuuccuuguaacuuuugagaacucagcucugguacuuuuucaugccuugcaaaauggcguuanugcagcuagcuugcuaanccuuaugguggggucuuucauuccccccucuuucuggaaacugnauaaaaucauuuauucacgugauucuauuucuucuggaucuauugauuugaguuggugauacuguugggucanaaccagggccuguu

SEQ ID NO: 17 - RNA, 4179 nt, Homo sapiens
cagcuccgagcuaggugcuaucgcaaggccagagcgcacagcccggcggagagagcagauccuugcucagaucgagucaaaucgggccaaggcggaggacgaagaguccaggcuccuauucuggacuuguuccccagcuccgggggcgcuucuagguccugcagcagccagcagugcggagccaccaacucggugcuggaaugaaaaaauucccgcgcgccagugcagaaucuuucuaagugacccggagcuucgggugcuagcucugcacgaacuuucccaucaaagugaucgugaauuuuaagcaucaggagcaggccagcgaagcucuacgcgucuaaacgucuauccagaccaagaguucucugcggugcagggugcggugccaugcagccaaaagucccuuuuggggucacgcaagcagaagcccugcuccgacaugggggacguccagcgggcagcgagaucucggggcucucuguccgcacacaugcuguugcugcuccucgcuuccauaacaaugcugcuaugugcgcggggcgcacacgggcgccccacggaggaagaugaggagcugguccugcccucgcuggagcgcgccccgggccacgauuccaccaccacacgccuucgucuggacgccuuuggccagcagcuacaucugaaguugcagccggacagcgguuucuuggcgccuggcuucacccugcagacuguggggcgcagucccggguccgaggcacaacaucuggaccccaccggggaccuggcucacugcuucuacucuggcacggugaacggugaucccggcucugccgcagcccucagccucugugaaggugugcguggugccuucuaccuacaaggagaggaguucuucauucagccagcgccuggaguggccaccgagcgccuggccccugccgugcccgaggaggagucauccgcacggccgcaguuccacauccugaggcgaaggcggcggggcaguggcggcgccaagugcggcgucauggacgacgagacccugccaaccagcgacucgcgacccgagagccagaacacccggaaccaguggccugugcgggaccccacgccucaggacgcgggaaagccaucaggaccaggaagcauaaggaagaagcgauuuguguccagcccccguuauguggaaaccaugcucguagcugaccaguccauggccgacuuccacggcagcggucuaaagcauuaccuucuaacccuguucucgguggcagccagguuuuacaagcaucccagcauuaggaauucaauuagccuggugguggugaagaucuuggucauauacgaggagcagaagggaccagaaguuaccuccaaugcagcucucacccuucggaauuucugcagcuggcagaaacaacacaacagccccagugaccgggauccagagcacuaugacacugcaauucuguucaccagacaggauuuauguggcucccacacgugugacacucucggaauggcagauguuggaaccguaugugaccccagcaggagcugcucagucauagaagaugaugguuugcaagccgccuucaccacagcccaugaauugggccauguguuuaacaugccgcacgaugaugcuaagcacugugccagcuugaauggugugaguggcgauucucaucugauggccucgaugcucuccagcuuagaccauagccagcccuggucaccuugcagugccuacauggucacguccuuccuagauaauggacacggggaauguuugauggacaagccccagaauccaaucaagcucccuucugaucuucccgguaccuuguacgaugccaaccgccagugucaguuuacauucggagaggaauccaagcacugcccugaugcagccagcacauguacuacccuguggugcacuggcaccuccgguggcuuacuggugugccaaacaaaacacuucccuugggcagauggcaccagcuguggagaagggaaguggugugucaguggcaagugcgugaacaagacagacaugaagcauuuugcuacuccuguucauggaagcuggggaccauggggaccguggggagacugcucaagaaccuguggugguggaguucaauacacaaugagagaaugugacaacccagucccaaagaacggagggaaguacugugaaggcaaacgaguccgcuacagguccuguaacaucgaggacuguccagacaauaacggaaaaacguucagagaggagcagugcgaggcgcacaaugaguuuuccaaagcuuccuuugggaaugagcccacuguagaguggacacccaaguacgccggcgucucgccaaaggacaggugcaagcucaccugugaagccaaaggcauuggcuacuuuuucgucuuacagcccaagguuguagauggcacucccuguaguccagacucuaccucugucugugugcaagggcagugugugaaagcuggcugugaucgcaucauagacuccaaaaagaaguuugauaaguguggcguuuguggaggaaacgguuccacaugcaagaagaugucaggaauagucacuaguacaagaccuggguaucaugacauugucacaauuccugcuggagccaccaacauugaagugaaacaucggaaucaaaggggguccagaaacaauggcagcuuucuggcuauuagagccgcugaugguaccuauauucugaauggaaacuucacucuguccacacuagagcaagaccucaccuacaaagguacugucuuaagguacagugguuccucggcugcgcuggaaagaauccgcagcuuuaguccacucaaagaacccuuaaccauccagguucuuaugguaggccaugcucuccgacccaaaauuaaauucaccuacuuuaugaagaagaagacagagucauucaacgccauucccacauuuucugagugggugauugaagaguggggggagugcuccaagacaugcggcucagguuggcagagaagaguagugcagugcagagacauuaacggacacccugcuuccgaaugugcaaaggaagugaagccagccaguaccagaccuugugcagaccuuccuugcccacacuggcaggugggggauuggucaccauguuccaaaacuugcgggaaggguuacaagaagagaaccuugaaaugugugucccacgaugggggcguguuaucaaaugagagcugugauccuuugaagaagccaaagcauuacauugacuuuugcacacugacacagugcaguuaagaggcguuagaggacaagguagcguggggaggggcugauacacugagugcaagaguacuggagggauccagugagucaaaccaguaagcagugagguguggcaaggagguguguguaggggauacauagcaaaggagguagaucaggacacuacccugccaguuacauucugauaagguaguuaaugaggcacaguagcaucugaaagaccauacagagcacuaaggagccccaaagcacuauuaguaucucuuuucuuauaucuaucgcccaaauaauuuucagagucuggcagaagcccuguugcacuguacuaacuagauacuucuuaucacaaagauugggaaaggcaaagcagaaagaugguaagacuggguuucaaacaaggcuugguuucaaucacuggaggcaaggaggaggggacaaacaagaucauuauucgaagucgcugguugcugugguuuuacggaagguugaugcaucauuccuaucaacagugaaaaguucagcuuguucaacgugacagaaaggcucaucuccgugaaagagcuccugauuucuucuuacaccaucucaguucuuaacuauaguucauguugagguagaaacaauucaucuauuuauaaaauguacauuggaaaaaaaaagugaaguuuaugagguacacauaaaaacugaaggaaacaaugagcaacaugccuccugcuuugcuuccuccugagguaaaccugccuggggauugagguuguuuaagauuauccauggcucacaagaggcaguaaaauaauacauguugugccagaguuagaaugggguauagagaucagggucccaugagauggggaacauggugaucacucaucucacaugggaggcugcugcag

SEQ ID NO: 18 - RNA, 1416 nt, Homo sapiens
ccgcgggcccgcguucaugcaccgccugcuggccugggacgcagcaugccucccgccgccgcccgccgccuuuagacccauggaaguggccaacuucuacuacgagcccgacugccuggccuacggggccaaggcggcccgcgccgcgccgcgcgcccccgccgccgagccggccauuggcgagcacgagcgcgccaucgacuucagccccuaccuggagccgcucgcgcccgccgcggacuucgccgcgcccgcgcccgcgcaccacgacuuccucuccgaccucuucgccgacgacuacggcgccaagccgagcaagaagccggccgacuacgguuacgugagccucggccgcgcgggcgccaaggccgcgccgcccgccugcuuuccgccgccgccucccgccgcgcucaaggcggagccgggcuucgaacccgcggacugcaagcgcgcggacgacgcgcccgccauggcggccgguuucccguucgcccugcgcgccuaccugggcuaccaggcgacgccgagcggcagcagcggcagccuguccacgucgucgucguccagcccgcccggcacgccgagccccgccgacgccaaggccgcgcccgccgccugcuucgcggggccgccggccgcgcccgccaaggccaaggccaagaagacgguggacaagcugagcgacgaguacaagaugcggcgcgagcgcaacaacaucgcggugcgcaagagccgcgacaaggccaagaugcgcaaccuggagacgcagcacaaggugcuggagcugacggcggagaacgagcggcugcagaagaagguggagcagcugucgcgagagcucagcacccugcggaacuuguucaagcagcugcccgagccgcugcuggccucggcgggccacugcuagcgcggcgcgguggcguggggggcgccgcggccaccgugcgcccugccccgcgcgcuccggccccgcgcgcgcgcccggaccaccgugcgugcccugcgcgcaccugcaccugcaccgaggggacaccgcgggcacaccgcgggcacgcgcggcgcacgcaccugcacagcgcaccggguuucgggacuugaugcaauccggaucaaacguggcugagcgcguguggacacgggacuacgcaacacacguguaacugucuagccgggcccugaguaaucaccuuaaagauguuccugcgggguuguugauguuuuugguuuuguuuuuguuuuuuguuuuguuuuguuuuuuuuuuuggucuuauuauuuuuuuuguauuauauaaaaaaguucuauuucuaugagaaaagaggcguauguauauuuugagaaccuuuuccguuucgagcauuaaagugaagacauuuuaauaaacuuuuuuggagaauguuuaaaagccaaaaaaaaaa

SEQ ID NO: 19 - RNA, 566 nt, Homo sapiens
  misc_feature (154)..(154): n is a, c, g, or u
  misc_feature (254)..(254): n is a, c, g, or u
  misc_feature (262)..(262): n is a, c, g, or u
  misc_feature (287)..(287): n is a, c, g, or u
  misc_feature (305)..(305): n is a, c, g, or u
  misc_feature (354)..(354): n is a, c, g, or u
  misc_feature (378)..(378): n is a, c, g, or u
  misc_feature (419)..(419): n is a, c, g, or u
  misc_feature (449)..(449): n is a, c, g, or u
  misc_feature (492)..(493): n is a, c, g, or u
  misc_feature (521)..(521): n is a, c, g, or u
  misc_feature (550)..(550): n is a, c, g, or u
aaaauguagaaggcaagauuuaauaaggcagcaacaugaaagcacacagaccagagcucuggggucgaaauaaagcagcaacauggaagcacacagagcucuggggucgaaacucauacaccuuagcacaggguagaggagucucgacggucanccagaauuuuucacaggcuuauauaguaaaacucaaagggggagaacugggcagggaaaguacaaguuuacaucacuagggaguucugccaaaggacaanggguucunucagaggaaucuacguaacuaaggngucauguccuaucaaggnaucuacguaacuaaggagucauguccuaucauuuggcaauguacccggnucuuuugagguuguuccggagggncuuauucucaaaauguuuuucagauuggaagggguggguunccgguaaaaaguucuguuuucaaagaggcnguaauuuucuauucuucauuccccauucuccuguaaguauucnnaucuuagaauuucagaaguccauauucncuauguggggaauaacuggcuuuaacccnaucuuuaaaauggggg

SEQ ID NO: 20 - RNA, 358 nt, Homo sapiens
  misc_feature (269)..(269): n is a, c, g, or u
uuuuuuuuuuuuuuuuuaugaaacaguuuuguucagcccaugacuuugugcaugacugucguccguucuagucaccugugcucuccaucuacugccuuuuaaagcugcgucaugagaaggaucuacacguuccaccaugacucucguuucuugccacaaguagaagaaaugguugauucuuugcuuuucgguuaggccguuaaacaaaacucagucacaccccugccuuccacccucaaacugugaucacguggcuguucuuguaguunaaccagggcaacacuauauauuccaggucuauacauugcugaggucuuuuucugguuguucauguaucaguguuuucaaccucgugccg

SEQ ID NO: 21 - RNA, 2149 nt, Homo sapiens
gcggccgcggcuccagaccccggccuugcgcacccuccccccaccuccagcccgcgccucccccccccccacgcauggcucaccaccccucggguuucccugucaucccucagguuccugcacuuggcaaucauccacgaagagaagccgcugaccauggaagucauuggucaggugaagggagaccuggccuuccucaacuuccagaacaaccugcagcaggugcgcugcuugcuugccccgcggugccccucuuugaccccuugguggagucagauguagcacggucgcccccaaagcguuucuaaauuaauagucacuuaguucuuaucugccuuggcuuuuuugcauucaaaucagccaacgucuuagaaccagaagaaaaaucccuugguuuuagugaggucuuuaugacccaccuagggccuccuguuugccugaucuccuaagagacaaaugggaggaucagauuccauagcgggaggugucugggguucaggaaacucaagacuauggguuugcuccauggcuuaucccuuucuguuuccucuuccauuuguagacuccacuccacuuggcugugaucaccaaccagccaggaauugcugaggcacuucugaaagcuggcugugauccugagcuccgagacuuucgaggaaauaccccucuacaucuugccugugagcagggcugccuggccaguguagcagucuugacgcagaccugcacaccccagcaucuccacuccguccugcaggccaccaacuacaaugguaggucugccaguccauccaaggaugcagaggagggagagagauggggccacuugagucuuaaacuccgaacguauacaaaguucagacacugugaucuuuuuaaaaaguuuucuccucgaugccuauaugauauucacucagaacccagauucugaguucuucaaaacugaugauguuugugguuguccucaagacaauagacaugaguugugugaggauugaaacacguaguacaguuuuugucuuccuccuccaggccacacgugucugcaccuagccucuacucacggcuaccuggccaucguggagcacuuggugacuuugggugcugaugucaacgcucaggugaguacaucucccuuccaccuaaucucuguugggcuggcucugauggugagcagguuuccagaugcagccguaaacuaacgccugauugcuuuugguuucaggagcccugcaauggccggacagcccuccaccuugcgguggaccugcagaauccugaccugguuucgcucuuguugaaauguggggcugaugucaacaggguaaccuaccaaggcuacucccccuaccagcuuaccuggggccgcccaaguacccggauacagcagcagcugggccagcugacccuggaaaaucuccagaugcuacccgagagcgaggaugaggagagcuaugacacggagucagaauucacagaggaugaggugaguguuccuccccucagcacgcugacggcuguucuagggcugcuuuggaucagagggauuucaguuguuuaacuucucagacucggcuugcaaagcaggaucccaagaauuugucucugguuuguuuuaagagcuuacccuuuugguugaggaaugagggaauucuagaaauugaacccaggccuuagcacauggugauaagcacacguucaaccauuaagcuccacccccucaauagcuuagacuuuuuuuuuuuuuaaggaaagaauagguaagggaaacuccuacagccuggugcccuuguucuauuuggguuaaggagaaaaagagcccaagaauaggaguuauuucagcagcagcucuccccuuaucccaaugucuuggugaaguucuaggaauuuaauaugucuuuuuccccucucuuguuuuagcugcccuaugaugacuguguguuuggaggccagcgucugacauuauaaguggaaaguggcaaaaaagaauguggacuuguauauuuguacaaauagaguuuuauuuuucuaaaaaaaaaaaaaaaaaaaaaaaaaaaaaaaaaaaguauacuuagcaccacaccacacagcgccuagacccaggcauuuuacuggggugauucggcuguugucuuugugaaauccgggg

SEQ ID NO: 22 - RNA, 2062 nt, Homo sapiens
cucucggucacugccggucgcuuccugagccgcugcuggcucugugucucuguccucagcguucucuuccucguccucguccuaccacgccauggaagguuaccauaagccagaucagcagaagcuccaggcccugaaggacacagccaaucgccugcgcaucagcuccauccaggccaccaccgcggcaggcucaggccaccccacaucaugcugcagcgcugccgagaucauggcuguccuguuuuuccauaccaugcgcuacaaggcccuggauccccgaaacccucacaaugaucgcuuugugcucucuaagggccaugcagcucccauuuuauaugcagucugggcugaagcuggcuuccugcccgaggccgagcugcugaaccugaggaagaucagcucugacuuggacgggcauccugucccgaaacaagccuucaccgauguggccacuggcucccugggccagggccugggagcugcuugcgggauggcauacacaggcaaauacuuugacaaagccagcuaccgagucuauugcaugcugggagacggggaggucuccgagggcuccgucugggaggccauggccuuugcuggaauuuacaagcuggacaaccucguugccauuuuugacaucaaccgccugggccagagcgacccagccccgcugcagcaccagguggacaucuaccagaagcgcugugaggccuuuggcuggcacaccaucaucguggacggacacagcguggaggagcugugcaaggccuuuggucaggccaagcaccaaccaacagccaucaucgccaagaccuucaagggccgagggaucacagggauugaagacaaggaggcguggcacgggaagccccuccccaaaaacauggccgagcagauuauccaggagauuuacagccagguucagagcaaaaagaagauccuggccacgcccccucaggaggaugccccauccguggacauugcuaacauccgaaugccuacgccacccagcuacaaagugggggacaagauagccacccggaaggccuauggacuggcccucgcuaagcugggccacgccagugaccguaucauugcccuggauggagacaccaagaauuccaccuucucggagcucuucaaaaaggagcacccagaccgguucauugagugcuacauugccgagcaaaacauggugagcauugccgugggcugugccacacgugaccggacagugcccuucugcaguacuuucgcggccuucuucacacgggccuucgaccagauucgcauggccgccaucucugagagcaacaucaaccucuguggcucccacugugguguguccauuggggaagacgggcccucucagauggcccucgaagaccuggccauguuccggucaguccccauguccaccgucuuuuacccaagcgauggaguugcaacagagaaggcaguggaguuagcagccaacacaaagggcauuugcuucauccggaccagccgcccagagaaugccauuauuuauagcaacaaugaggauuuccaggucggccaagccaaggugguccugaagagcaaggaugaccaagugacagugaucggggcugguguaacucugcaugaggccuuggcugcugcagagagucuaaagaaagauaagaucagcauccgggugcuggaucccuucacuaucaagccccuggacaggaaacucauccuagacucugcccgagcaaccaaaggcaggauccucaccguggaggaccacuacuacgaagguggcauaggagaggcagugucugcugccguagugggugaaccuggagugacggucacucgccuggcugucagccaaguaccacgaaguggcaagccagcugagcuacugaagauguucgguauugacaaggacgccauugugcaagcugugaaaggccuugucaccaagggcuagggagggcaugggaugcugggugggugaacuacacauuccagggagguucuggcagagguggcgaagguguacugaguggggagguaaauauauguuuug

SEQ ID NO: 23 - RNA, 230 nt, Homo sapiens
uuaacggugucauaaauaaguaauauaacuuuauuaaaaugaaaagacaauauucaaaauaaugcaacaaaaugaauaaauccuuuguccaauacuguacacacagugcggagaucagugcauuuuucuaaagcauguuuuaaccuucauuuaguucauacuaaaguaagcuuuaaauagcucaaauaaugucauucagcaguuuaaacugaacagcuuguugggacaug

SEQ ID NO: 24 - RNA, 1560 nt, Homo sapiens
ugaguucucguaaacuccagagcagcgauaggccguaauaucggggaaagcacuauagggacaugauguuccacacgucacaugggucguccuauccgagccagucgugccaaaggggcggucccgcugugcacacuggcgcuccagggagcucugcacuccgcccgaaaagugcgcucggcucugccaggacgcggggcgcgugacuaugcgugggcuggagcaaccgccugcugggugcaaacccuuugcgcccggacucguccaacgacuauaaagagggcaggcuguccucuaagcgucaccacgacuucaacguccugaguaccuucuccucacuuacuccguagcuccagcuucaccagaucucggaauggaccccaacugcuccugcuccaccgguaagacucccgauccuuggucuuuagaauaccaaguugggaccgcagagcggaauccccgaguuguagaggcuuggcgggaauaggcaccuuuaguuggcgauucauuccgguucuuucuagaauccgcucuugcaaaagccuucauuaguuacgaguauugucgaacggguccuuuggcgggguuggggcuaggauuuagacgcgcaaauguccgguuccugaucacccaguuaguggggacaucuggguugagucccaggcauuacuaaacuuacugugaauugcuugaauuaagaaagaggugaaggaccuuuaugucuugggacucaaagacauaaucccugacuuaaccugugaggagaaaaguggggcuaggcucccugcagcuccgaggaggacuuagugaacugagccgggacucgugguguuggccacugcuguaaugcugccucccucaugcugucuucuuucuccucccaggcggcuccugcacuugcaccagcuccugcgccugcaagaacugcaagugcaccuccugcaagaagagugaguugggacaccuuggguggcggcuaaggcuaggggcggggaacuccuacaaaacuggcucugagaaauguccuuugcuucccggaggccauuguauugucucggggacagaacuauacagagaacuauuuaaaaaaaccgaggucuucucuguuggggacaggaagcagaggucuucagccaggcugccucuuccuccuucuucuaggcugcugcuccugcugucccgugggcugcuccaaaugugcccagggcugugucugcaaaggcgccgcggacaagugcacgugcugugccugaugugacgaacagcgcugccaccacguguaaauaguaucggaccaacccagcgucuuccuauacaguuccacccuguuuacuaaacccccguuuucuaccgaguacguuaauaauaaaagccuguuugagucuaacucugguuucuuggugugguuuggcaauaagaaacuggggugacuugauagucuggggaucugguuuuggacccccucgugccuuuaccuccgcccucuggcccucacagagggguaaugucuuuggguaaagccaagcuauaucccauaagcuuccucauggaaaacagcug

SEQ ID NO: 25 - RNA, 253 nt, Homo sapiens
gcggcacgaugugucuucggguggcuuuuuuuuuuuuguuuugaauaauguuuacaauuucccucaaucacuuuuauagaaauccaccuccaggccccccccuuuccccacuuaggccuucgaggcugucugaagaugcuugagaaacucaaccaaaucccaguucaauucagacuuugcacauauauuuauauuuauaaucagaaaagaaacauuucaguaauuuauaauaaaagagcacuauuuuuuaacg

SEQ ID NO: 26 - RNA, 3660 nt, Homo sapiens; identical to SEQ ID NO: 11

SEQ ID NO: 27 - RNA, 1969 nt, Homo sapiens
acugccaucgagugguguuccaguugaacuugcucucucugccaucugcuccgcgggcgccgucagcaugggucccuggacccacuccuugcgcgccguccugcugcuggugcuuuugggagucugcaccgugcgcuccgacacuccugccaacugcaccuacccugaucugcugggcaccuggguguuccaggugggcccuagaaguucccgaagcgacauuaacugcucggugauggaagcaacagaagaaaagguagugguacaccuuaagaaguuggauacugccuacgacgagcugggcaauuccgggcauuuuacccucauuuacaaccaaggcuucgagauuguguugaaugacuacaaaugguuugcguuuuucaaguaugaagucagaggccacacagcuaucaguuacugccaugagaccaugacuggguggguccaugaugugcugggccggaacugggcuugcuuuguuggcaagaagguggaaagucacauugagaagguuaauaugaaugcagcacaucuuggaggucuccaggaaagauauucugaaagacucuacacucacaaccacaacuuugugaaggccaucaauaccguucagaagucuuggacugcaacugcauauaaggaauaugagaaaaugagccugcgagaucugauaaggagaaguggccacagccaaaggaucccaaggcccaaaccugccccgaugacugaugaaauacagcaacaaauuuuaaauuugccagaaucuugggacuggagaaacguccaaggcgucaauuauguuagcccuguucgaaaccaagaaucuuguggaagcugcuacucauuugccucuauggguaugcuagaagcaagaauucguauauuaaccaacaauucucagacaccaauccugaguccucaggagguuguaucuugcagccccuaugcccaagguugugaugguggauucccauaccucauugcagggaaguaugcccaagauuuuggggugguggaagaaagcugcuuucccuacacagccaaagauucuccaugcaaaccaagggagaauugccuccguuacuauucuucugacuacuacuaugugggugguuucuaugguggcugcaaugaagcccugaugaagcuugagcuggucaaacauggacccauggcaguugccuuugaaguccacgaugacuuccuacacuaccacaguggaaucuaucaccacacugggcugagugacccuuucaaccccuucgagcugacaaaucaugcuguuuugcuugugggcuauggaagagauccaguuacugggauagaauacuggauuauaaagaacagcuggggcucuaacuggggggagaguggcuacuuccguauccgcagaggaacugaugaaugugcaauugagaguauagccguggcggccauaccgauuccuaaauuauaggacauagcucccaguguuacauacgggucuuuaucacucacagagugauuuagucacaugcugaagacuuuuucagagcaauaucagaagcuuaccacuaagcaucuuuaaagaauuuugucuuugaacuuaaaaccauccuugauuuuuuucuuuuaauaucuuccccaucaacuacugaacuacuuuucuuuuuaaaguacuugguuaaguaauacuuuuaugagcagugguucaguuguccaauauuuuuugcaggucaucuacaaugcaaccagauguuucaguucuaaaaaucuauguaaaaguacaagcucguuuuuaaauuauguaagucacaugaaaacauggcaaaaaaauuaguuaaauuuuuuacaaagaguuuuaaauaaauguuuauguaaucaguaccauagucuuucuauguguguuuacaagaauuuuugucaccuacuucuucccuuagaagcauuuaugcuccauggacguacuucuuuauggagaaaaaaaaaa

SEQ ID NO: 28 - RNA, 1478 nt, Homo sapiens
gagcucgaucccuguuccgccuuugcuaugucugaaggcguccugcuuugcgcgugucggggccaaauccagauuuucauuucgcuccaggcuuggacggcuaaguagguccaaaccgcacaaacaggaaggagggaaggcaaggagugcgggcagagggcgggucguucccagcagcaccccagucccuccccgcuccgucuccgacccacuggggccggggcgggcgugcgcgucagcuggggcuagaaaaggcggcgguccggcccggcgaggugacagccaacuuggacgccagguccggccgacgccgccaugagcgccgcgcuuuucagccuggacagcccggugcgcggcacacccuggcccacagaacccgcggccuucuacgagccaggcaggguggacaagcccggccgagggcccgagccaggggaacugggggagcugggcuccacgacuccugccauguacgacgacgagagcgccaucgacuucagcgccuacauugacuccauggccgccgugcccacccuagagcugugccacgacgaacucuucgccgaccucuucaacagcaaccacaaagcggccggcgcgggcggccuggagcugcugcagggcggcccuacgcgacccccggguguggggucugucgcuagggggccgcucaagcgcgaacccgacuggggcgacggcgacgcgccgggcucccugcugccggcgcaaguggcggugugcgcgcagacaguggugagcuuggcggccgcggcucagcccacuccacccacuucgccggagccuccucgaggcagcccggggccgagccucgcgcccggcacaguccgagaaaagggcgcgggcaagagggguccggaccgcggcagcccggaguaccggcagcggcgcgagcgcaacaacaucgcugugcgcaagagccgcgacaaggccaagcgccgcaaccaggagaugcagcagaagcugguggaguugucggccgagaacgagaagcugcaucagcgcguggagcagcucacccgggaccuggcuggccuccggcaguucuucaaaaaacugcccagcccgccuuuccugccgcccaccggcgccgacugccgguaacgcgcggcgugggccuuugagacucugaacgaccuauaccucagaccccgacagcggggagcagacgccgcccgaaucgcuaguuucuuugggaccugcgagcgacaggaagcugcagcuugggcacuggacugcgagagaagcuauauuaaucuuuccccuuaaauuauuuuuuauaaugguagcauuuucuacgucuuauuaccauugcagcuaagguacauuuguagaaaagacauuuccgacagacuuuuguagauaagaggaagagacugcgcaugcuuuuuauauucauuuuuacaguauuuguaagaauaagaauaagaauaaagaagcauuuaaaucgcaaaaaaaaa

SEQ ID NO: 29 - RNA, 1786 nt, Homo sapiens
uugaggguggccaggccagcguaggaggccagcguaggauccugcugggagcggggaacugagggaagcgacgccgagaaagcaggcguaccacggagggagagaaaagcuccggaagcccagcagcgccuuuacgcacagcugccaacuggccgcugccgaccgucuccagcucccgaggacgcgcgaccggacaccggguccugccacagccgaggacagcucgccgcucgccgcagcgagcccggggcggcccuucagggggaccuuucccagaucgcccaggccgcccggaugugcacgaaaauggaacagccuuucuaucacgacgacucuuacgcagcggcgggauacggucggagcccuggcagccugucucuacacgacuacaaacuccugaaacccaccuuggcgcucaaccuggcggaucccuaucggggucucaaggguccuggggcgcgggguccaggcccggagggcaguggggcaggcagcuacuuuucgggucagggaucagacacaggcgcaucucugaagcuagccuccacggaacuggagcgcuugaucguccccaacagcaacggcgugaucacgacgacgcccacgccuccgggacaguacuuuuacccccguggggguggcagcgguggagguacagggggcggcgucaccgaggagcaggagggcuuugcggacgguuuugucaaagcccuggacgaccugcacaagaugaaccacgugacgccccccaacgugucccugggcgccagcggggguccccaggccggcccagggggcgucuaugcugguccggagccgccucccgucuacaccaaccucagcaguuacucuccagccucugcacccucuggaggcuccgggaccgccgugcggacugggagcucauacccgacggccaccaucagcuaccucccacaugcaccacccuuugcgggcggccacccggcacagcuggguuugagucguggcgcuuccgccuuuaaagaggaaccgcagaccguaccggaggcacgcagccgcgacgccacgccgccugugucccccaucaacauggaagaccaggagcgcaucaaaguggagcgaaagcggcugcggaacaggcuggcggccaccaagugccggaagcggaagcuggagcgcaucgcgcgccuggaggacaaggugaagacacucaaggcugagaacgcggggcugucgagugcugccggucuccuaagggagcaaguggcgcagcucaagcagaaggucaugacccaugucagcaacggcugccaguugcugcuaggggucaagggacacgccuucugagagccucccuugccccauacggacacccccagccuugaaggcugggcgccugccccccacuggggugaggggggcaggcgaugggcacccgccaaaaggccuggggcgcagcucacacacuggacuccggcccgcccgccugcgcccaguccuuccaccucgagguuuacauggcccccuuccagcguauuuuguauguuuuuuuuuucugcaaagagacugaauucauauugaauauaauauauuuguguauuuaacaggagggagaagggggcugucgcggcggagcuggccgccgcuugguacucagcugcggggauacuagggagggaccuccgcccccugcccucccccucugcauaguacuguggagaagaaacacgacuucgugucuaaagucuauuuuaagauguguuuguguguguguguuugacuuuuuauugaaucuauuuaagua

SEQ ID NO: 30 - RNA, 1897 nt, Homo sapiens
gaauucggcacgagcagcgagacgccgcgcacggugcuuccccaguggagccaaucggcuaacccgcgcuccggcagaguccuuggcgcucgcccgccggcgggacagaccacccgccucuggccgcucucuggacccuggccgccccgagcgaagacuggagcaaaaugaugcuucaacauccaggccaggucucugccucagaagucagugcgaccgccauuguccccugccucucaccuccugggucacugguauuugaggauuuugcuaaccugacacccuuugucaaggaagagcugagauucgccauccagaauaaacaccucugccaucggauguccucugcgcuggagucaguuaccgucaacaacagaccccuggagaugucagucaccaagucugaggcggccccugaagaagaugagaggaaaaggaggcggcgagaaagaaauaaaauugcugcugccaagugucgaaacaagaaaaaggagaagacagagugccugcagaaagagucagagaaacuggagagugugaaugcugagcugaaggcccagauugaggagcugaagaaugagaaacagcauuugauauacaugcucaaccugcaccggcccaccuguaucguccgggcucagaauggacggacaccggaagacgagaggaaccucuuuauccaacagauaaaagaaggaacauugcagagcuaagcagagguggcacggaggcaauuggggaguucuuacugaauccuccuuuuccaccccacacccugaagccauuggaaaacuggcuuccugugcacuucuagaaucccagcagccaagagccguuggggcaggagggccuguggugaccuacugcauugacccacucugcccccgagugaaccguggagcaggcaggagcauccuuugucucaccaauuccaggauuuaggccuuaucaucccggccagucucagaugaccuagcuggccccaggcugggguccuaugcaaagcaggaucccacuaaugggauucaggcagaagugucuaccuugauagguggggugggaccacauccuccacuguggcugacaacgcccuuccaagggaauauggaaugagaacauucauuauugagguuguccaauggccaggguaugcuuucuagaaaauaugcuguucugucccagaaugacugugcauaggguauccguuucagagccugguguugugcuauuuagauguuugucuugcacaacauuggcaugauuuuuccgggaguuucaucagaucugauuucugagagucuggggaucugccaugguggaaagugccccucaaaagcauuuguguggccacaugaacuggcuggcaccaggggagugaaacuggcugaugaccagcugagccacuuugugccaacagaggauggacgacaccuuucccuguacccacugcagaggaagaacccugggcacagcagcuuuguccuuggcuacaaacuguuacaacgucacacaaugaaggcacaaaguccaacuuucaaaggguguaggacuccauacucagugacagggcaggaagagccaaagauaaccacagccacagccuguggagaccaggguuggaagccaggugcagggccaggcaucugcauugugggauguuaauggcacuuuugucuuguagcuauuuugagaugugguccagagcauuucagcugggagaucucccucuggccaccaggacucuggcuacuguuaaaauccugauguuucuguggaauccucaguguuuaaucccacucaauaguaucauuacaguuuucuguaagagaaaauauuacuuauuuaucccaguauuccuagccugucaacauaauaaauaucggaacaaaaccuggua

SEQ ID NO: 31 - RNA, 473 nt, Homo sapiens
uuuuuuuuuuuuuuuuugcugauaagaauucuuuuuauguuauucgaauaaaaaauacauucauacagaaauauaacaaucucgcaaaaaacaauuucaaauaaaaucuuguaaaacaaaauuuuacaaaaaucuuacaaagauucuuuagauaacagggugcuucaaaaaaaaagaaauaaagaaauuucacuaauagaaauuuuuuuuuuuaauuucaagcaaaaguuccugcuugauugaggcucaguugucaccugaccagaauggacugcuuaguauuaaaguuacagcaucgacacggacggcacccagccccagccaguccagcaacgucgcuguguuucauaagugagacgcgccagcacaaguuuccucucucuucuguuuaccuucuuacuuaauggaauugcuauggauaagcacacagcagggccaaaaaaggaguuuuccaaaauccagcaaaucaagug

SEQ ID NO: 32 - RNA, 1680 nt, Homo sapiens
uaguggugaucuggaccgugcggacuugcucgucccucagcucuccuguuaggcgucucuuuucuccaggaggaaaaaauggcagcagcaguaguggauccgcaacagagcguggugaugagaguggccaaccugcccuuggugagcucuaccuacgaccuuguguccuccgcuuaugucaguacaaaggaucaguacccguauuugagauccgugugugagauggccgagaagggcgugaagaccgugaccucugcggccaugacaagugcccugcccaucauccagaagcuggagccacaaauugcgguugccaauaccuaugccugcaaggggcuagacaggauggaggaaagacugccuauucugaaccagccaacguccgagauuguugccagugccagaggugccguaacuggggcgaaggauguggugacgacuaccauggcuggagccaaggauucuguagccagcacagucucaggggugguggauaagaccaaaggagcagugacuggcagcguggaaaggaccaagucuguggucaauggcagcaucaauacaguuuuggggauggugcaguucaugaacaguggaguagauaaugccaucaccaagucggagaugcugguagaccaguacuucccucucacucaggaggagcuggagauggaagcaaaaaagguggaaggauuugauaugguucagaagccgagcaacuaugaacggcuggagucccugucuaccaagcucugcucucgggcuuaucaccaggcucucagcaggguuaaagaggccaaacaaaagagccaggagaccauuucucagcuccacuccacuguccaccugauugaauucgccaggaagaauaugcacagugccaaccagaaaauucagggugcucaggauaagcucuaugucucguggguggaguggaagagaagcaucggcuacgacgacaccgaugagucccacuguguugagcacaucgagucacguacucuggcuaucgcccgcaaccugacccagcagcuccagacuacaugccagacuguccuggucaacgcccaaggguuaccacagaacauucaagaucaggccaaacacuugggggugauggcaggcgacaucuacuccguauuccgcaaugcugccuccuuuaaggaaguguccgauggcguccucacaucuagcaaggggcagcugcagaaaaugaaggaauccuuagaugaaguuauggauuacuuuguuaacaacacgccucucaacuggcugguaggucccuuuuauccucagucuaccgaggugaacaaggccagccugaagguccagcagucugaggucaaagcucaguaaaccccuccuugucaccagagcaugauguugcuggccagaugaccccuuuugcuguauugaaauuaacuugguagauggcuuuagcuuagaaaagcagcuucuuagaaccaagggccucauuauggucacucacagcucaguuauggucuugccccagcuggcccuggcacaggaguucucuuaccuggcuggugaguggccuguguuagucuugugaggaccuggaggaaccuaaaagcucagaugcacuuacagucuugucuguggccuuuguauuguuauuggcuguaaacgucugucuggaccgaauaaagauucacguga

SEQ ID NO: 33 - RNA, 1783 nt, Homo sapiens
ggcacgagggagcugcaguguucgcgcuugguagcuggugcaucggacucagcuggcuuugugucccugaggcucaccgaaaaacacuuucucagcccucugacuccagagagagagagagagagguacuuuuuguggucaccgacuuugaccccugcagaggcugagcgauggcgucuaugggacuacagguccugggaaucuccuuggcaguccugggcuggcuggggaucauccugaguugugcgcuccccauguggcgggugaccgccuucaucggcagcaacaucgucacggcacagaccagcugggagggccucuggaugaacugcguggugcagagcacaggucagaugcagugcaagauguacgacucgaugcucgcccugccgcaggaccugcaggccgcccgagcccuuauggucaucagcaucaucgugggugcucuggggaugcuucucucagugguagggggcaagugcaccaacugcauggaggacgagaccgucaaggccaagaucaugaucaccgccggagccguguucaucguggcaagcaugcugauuauggugcccguguccuggaccgcucacaacgucauccgcgacuucuacaacccuaugguggcuuccgggcagaagagggaaaugggggccucgcuuuacgucggcugggcggccuccgggcugcugcuccugggaggaggccuccucugcugcaguugcccaccucguagcaacgacaagcccuacucggccaaguacuccgccgcccgcucuguccccgccagcaacuauguguaaggugggccacucuguccacauugccuuuguuauuuuuuuucggauugagcucauaacagccuguggccccucacauucuccaggaccugcccugcuaugggccacuaacugcuugcuggggacaggcaaacccggacugugcaaaguuacuagcccguagcucuugggcugcuccacauggcuccuuacggccggcaagaauggauguaaaaauaucuugcugcuuacauccaaauugcgguggauaugggcugaaggcagaagcagcugggaagggcaguagaggcgcaagcuggguccugcuggccgggguagcucagcugugacuuuggacucggaguggauguccucauguuagcaaacguccacuguccuuucucuaucccccucacucagccuacacguuacuccagcgcuacucuugccauuacgccccguguuuccgagcacagcugguccuaccccaagucauggugugcugagugacugaugaggggccauugagagccggugggcucugccauggaacccuuccguugauuagcaaugacugugcuugacccacccaccuacccuacuaaugaauuucuguagaguggauggacggguuugagggaagaaggguggagguggauuaaacugguuuggggagggcuggggaccuagaagcagcccaguguguccccaccccuuuuccgcacugucuugcuaauguucugaucacugugcgcccccucccucuucagaaggacccugggccucuugaguuggccccucugaguucccucccuuugcccauuucaaggacaccggccagucugcggaaggaagguacggggggggggggggggggugauggcauuguaccagggagucuccuggacuccccugccuucucugugguuucuuguuuuguaauuaaggucuguucacagcuguaauuauuauuauuuucuacaauaaauggcaccugcauacag

SEQ ID NO: 34 - RNA, 1786 nt, Homo sapiens; identical to SEQ ID NO: 29

SEQ ID NO: 35 - RNA, 1389 nt, Homo sapiens
augcagcugagaaaaaugcagaccaucaaaaaggagcccgcaccccuagauccuaccagcagcucagacaagaugcugcugcugaacucugccuuagcugagguggccgaggaccuagccucaggugaagauuugcuccugaacgaagggagcauggggaaaaacaaauccucggcgugucggagaaaacgggaauucauuccggacgagaagaaagacgccauguauugggagaaacggcggaaaaacaacgaagcugccaaaagaucucgggagaagcgccgccucaaugaccugguuuuggagaacaagcugauugcccugggagaagaaaaugccacuuuaaaagcugagcugcucucccugaaauuaaaguuugguuuaauuagcuccacggcguaugcccaagaaauccagaaacucaguaauuccacagcugucuacuuucaggacuaccagacauccaaggcugccgugagcucuuuuguggacgagcaugagccugcgaugguagccggaaguugcaucucagucaucaagcacucuccccagagcucgcucuccgaugugucagagguguccucgguggagcacacucaggaaagccccgcacagggaggcugccggagcccugagaacaaguucccugugaucaagcaggagcccguggaguuggagagcuuugccagggaggccagggaggagcggggcacguauuccaccuccaucuaccagagcuacaugggaagcucuuucuccacuuacucccacuccccaccccucuugcagguccauggguccacuagcaacuccccaagaaccucagaggccgaugaggguguagugggcaagucuucugauggggaagacgaacaacaggucccuaagggccccauccauucuccaguggagcugcaacggguucacgccacgguggugaagguuccggaagugaacccuucugccuuaccgcacaagcuucggauuaaagccaaggccaugcaggucaaaguggaggcuuuggacagcgaguuugaaggcaugcagaaacucucuucacccgccgaugcgaucgccaaaagacauuuugaccuggagaaacauggaaccucggguauggcccauuccucccucccuccuuucucagugcaggugacgaacauucaagauuggucccucaaaucggaacacuggcaucacaaagaacugagcagcaaaacucagaguagcuucaaaacaggugugguggaagucaaagacgguggcuauaagguuuccgaagcugagaauuuguauuugaagcagggaauagcaaacuuaucugcagagguggucucgcucaagagauucauagccacacaaccgaucucggcuucggacuccagguaa

SEQ ID NO: 36 - RNA, 961 nt, Homo sapiens
gcucccgggaaacgaaugaggaaccaccuccuccugcuguucaaguacaggggccuggugcgcaaagggaagaaaagcaaaagacgaaaauggcuaaauuuaagauccguccagccacugccucugacugcagugacauccugcgacugaucaaggaacuggcuaaauaugaauacauggaagaucaagucauuuuaacugagaaagaucuccaagaggauggcuuuggagaacaccccuucuaccacugccugguugcagaagugccuaaagagcacuggaccccugaaggacauagcauuguuggguucgccauguacuauuuuaccuaugacccauggauuggcaaguugcuguaucuugaagacuucuucgugaugagugauuacagaggcuuugguauaggaucagaaauuuugaagaaucuaagccagguugccaugaagugucgcugcagcaguaugcacuucuugguagcagaauggaaugaaccaucuaucaacuucuacaaaagaagaggugcuucggaucuguccagugaagagggauggaggcucuucaagauugacaaagaguacuugcuaaaaauggcagcagaggagugaggcgugccgguguagacaaugacaaccuccauugugcuuuagaauaauucucagcuucccuugcuuucuaucuuguguguagugaaauaauagagcgagcacccauuccaaagcuuuauuaccagugacguuguugcauguuugaaauucggucuguuuaaaguggcagucauguaugugguuuggaggcagaauucuugaacaucuuuugaugaagaacaaggugguaugaucuuacuauauaagaaaaacaaaacuucauucuugugagucauuuaaauguguacaauguacacacugguacuuagaguuucuguuuugauucuuuuuuuuuaaauaaacucgcucuuugauuu

SEQ ID NO: 37 - RNA, 2187 nt, Homo sapiens
cgcuggcuccgugcgccauggucacccacagcaaguuucccgccgccgggaugagccgcccccuggacaccagccugcgccucaagaccuucagcuccaaaagcgaguaccagcugguggugaacgccgugcgcaagcugcaggagagcggauucuacuggagcgccgugaccggcggcgaggcgaaccugcugcucagcgccgagcccgcgggcaccuuucuuauccgcgacagcucggaccagcgccacuucuucacguugagcgucaagacccagucggggaccaagaaccuacgcauccagugugaggggggcagcuuuucgcugcagagugacccccgaagcacgcagccaguuccccgcuucgacuguguacucaagcuggugcaccacuacaugccgccuccagggacccccuccuuuucuuugccacccacggaacccucguccgaaguuccggagcagccaccugcccaggcacuccccgggaguacccccaagagagcuuacuacaucuauucugggggcgagaagauuccgcugguacugagccgaccucucuccuccaacguggccacccuccagcaucuuugucggaagacugucaacggccaccuggacuccuaugagaaagugacccagcugccuggacccauucgggaguuccuggaucaguaugaugcuccacuuuaaggagcaaaagggucagaggggggccugggucggucggucgccucuccuccgaggcacauggcacaagcacaaaaauccagccccaacggucgguagcucccagugagccaggggcagauuggcuucuuccucaggcccuccacucccgcagaguagagcuggcaggaccuggaauucgucugaggggagggggagcugccaccugcuuuccccccucccccagcuccagcuucuuucaaguggagccagccggccuggccuggugggacaauaccuuugacaagcggacucuccccuccccuuccuccacacccccucugcuucccaagggagguggggacaccuccaaguguugaacuuagaacugcaaggggaaucuucaaacuuucccgcuggaacuuguuugcgcuuugauuugguuugaucaagagcaggcaccugggggaaggauggaagagaaaagggugugugaaggguuuuuaugcuggccaaagaaauaaccacucccacugcccaaccuaggugaggagugguggcuccuggcucuggggagaguggcaaggggugaccugaagagagcuauacuggugccaggcuccucuccauggggcagcuaaugaaaccucgcagaucccuugcaccccagaacccuccccguugugaagaggcaguagcauuuagaagggagacagaugaggcuggugagcuggccgccuuuuccaacaccgaagggaggcagaucaacagaugagccaucuuggagcccagguuuccccuggagcagauggaggguucugcuuugucucuccuauguggggcuaggagacucgccuuaaaugcccucugucccagggauggggauuggcacacaaggagccaaacacagccaauaggcagagaguugagggauucacccagguggcuacaggccaggggaaguggcugcaggggagagacccagucacuccaggagacuccugaguuaacacugggaagacauuggccaguccuagucaucucucggucaguagguccgagagcuuccaggcccugcacagcccuccuuucucaccuggggggaggcaggaggugauggagaagccuucccaugccgcucacaggggccucacgggaaugcagcagccaugcaauuaccuggaacugguccuguguuggggagaaacaaguuuucugaagucagguauggggcuggguggggcagcuguguguugggguggcuuuuuucucucuguuuugaauaauguuuacaauuugccucaaucacuuuuauaaaaauccaccuccagcccgccccucuccccacucaggccuucgaggcugucugaagaugcuugaaaaacucaaccaaaucccaguucaacucagacuuugcacauauauuuauauuuauacucagaaaagaaacauuucaguaauuuauaauaaaagagcacuauuuuuuaaugaaaaaaaaaaaaaaaaaaaaaaaaaa

SEQ ID NO: 38 - RNA, 2046 nt, Homo sapiens
aaggaaucuucaguacagaaacaagacccaaguguaaguuuaacuggcaggaggaaccaaccaaggacaguuaaggagaaaacccaacccuuagaagaacucaccaguuuccaagaggaaacugccaaaagaauaucuuccaaaucuccacaaccggaagagaaggaaaccuuagcagguuuaaagaggcagcucagaauacaacuaaucaacgaugguguaaaagaagagcccacagcacagagaaagcaaccauccagggaaaccaggaacacacucaaagagccuguaggugacaguauaaauguugaagagguuaagaagucuacaaagcagaaaauugauccaguagcaagugugccugucagcaagaggccacggaggguacccaaggaaaaggcacaggcccuagaauuggcuggucucaaaggaccaauccaaacccuaggccacacugaugaaucagcaagugauaaaggacccacacagaugcccuguaauucucuacaaccagagcaaguugacagcuuccaaagcucaccaaggcgacccaggacaagacgugggaaaguagaggcagaugaagagccuucagcaguaagaaagacaguaucaacaucaaggcaaacuaugcgaucccgcaaggucccugaaauugguaacaaugguacccaaguuucaaaggccuccauaaagcagacauuagauacaguagccaaaguaacuggcagcaggaggcagcuaaggacacauaaaggaugggguucaacccucuugaaguuguuaggugacuccaaagaaauaacccaaauaucagaucacucugagaaacuagcacaugacaccaguauccuuaagagcacucaacagcaaaagccagacucaguaaaaccucugagaacaugcagaagagugcugagggccucuaaagagguccccaaggaaguguugguggacaccagagaccaugcaacauuacaaagcaaaagcaacccuuugcuguccccgaagaggaagucugcaagagauggaagcauugugagaaccagggcuuugcgcucuuuagcaccaaagcaggaagcaacagaugagaagccuguaccugagaaaaaaagggcugcuuccagcaagagguauguaucaccugagccugugaagaugaaacaccugaaaaucgugucaaacaaacuugaaucuguggaagagcagguuagcacuguuaugaaaacagaagaaauggaagccaaaagagaaaauccugucacuccagaucagaacucuagguaccgaaagaaaaccaauguaaaacagccaaggcccaaguuugaugcaucugcagagaaugucgggauaaagaaaaacgagaagacuaugaagacugccucccaggagacagagcugcagaauccagaugauggagccaagaaaucuacaucucggggccaagucagugggaaaagaacaugcuugaggucuagaggaacgacugagaugccccagccuugugaagcagaagagaaaacaagcaaaccagcugcagaaaucuugauaaagccucaggaagagaaaggagucucuggagagucugauguuagguguuugagguccagaaaaacuagagucgcuuuggacagugaaccuaagccaaggguaacucguggaaccaagaaagaugcaaaaacucugaaggaggaugaagacauuguaugcaccaagaaguuaagaacaagaaguuaagaacaagaaguuaccagaaaagugaaacuauguagcaaagacauuuaagaaggaaaaguaaauuugacuuagugauaaguuccagugugguuuucaccuccaguguaaagaugaacuguaaauacuacugcuacugccugaguuuaaggaaggaagcuuugagcuuuccuggucauacucucuucagacgccaauggaggucaugaggaagaucaccagggaucucagcgcaauuacaguuuaggggugagcaggcagaaauguggcccucuguccuauccaauaaagcucugaaauucgcugccaaaa

SEQ ID NO: 39 - RNA, 423 nt, Homo sapiens
uuuuuuuuuuuuuuuuuaaaucaaaaguuaugaugacuuuauuuuaaaucuuaauacaccaaaaauauuuuucaauguugugagauaagcacuugaaaauaagaauuccaacacugcugugauuucgcugugaggcuugauagugaauuuucccucugaauauggguuuagggccuaggaagcagaaugccagucauuuuccaaguagcagugagcuaagcccagcccggucaugcucagacccacacuuaacugaaauauucacacuaggaggcggcaccaccaggcaacaccuugaucaaccaggagaacaaaagucugaagugccaccaagcauuggggaaaugauauuguuuagaugcuagugagucagguucuuucaaauguguccuaacuggguugcaaacauaguugcauccuuau

SEQ ID NO: 40 - RNA, 434 nt, Homo sapiens
gucuguaaaaaucuguuuaauaaauauacaucuuagaaguaccaaaauaauuaccaacaaaauacaacauauacaacauuuacaagaaggcgacacagaccuuaguugggggcgacuuuuaagcacaugccacugaacaccuggcucuuacaugggaggacacacugggcucacuuacuaggucuauggugguucaaucaaaagcacaauaaauaaaacgugguccuuucauuagguucuggaaaaucaccucccccccccccaaaaaaaaucccacaaacaugaaccuuaagagacauuuucuuugaauuucagugaucuguuuccccggauuucacaaagacaacagccgaaucaccccaguaaaaugccugggucuaggcgcugugugguguggugcuaaguauacccuuucucauuuuuuuucuuuuucu

SEQ ID NO: 41 - RNA, 1000 nt, Homo sapiens
cggccgccagaccuucaagggcuggaguggacgcgcggaccgacucugaacagacagacgaaccgcggccgcaagguucccagacaggaucucacccagaggcaggcagcggacagugccuuaguggaaccucgcuguccuccaccgccuggccccggugcaggcguccaguggccgccgcauccaaagugaucgcugccuccccgucuccgccagcucgggaccaugaagcugcugccgucggugaugcugaagcucuuucuggccgcaguguuguccgcguuggugaccggugagagucuggagcggcuucggagaggucuggcggcagcaaccagcaacccugacccucccacuggauccacaaaccagcugcuacccacgggaggugaucgugcucaggggguccaggacuuggaagggacagaucugaaccuuuucaaaguugcuuucuccuccaagccacaaggccuggccaccccaagcaaagaaaggaaugggaaaaagaagaagaaaggaaagggguuagggaagaagagagacccaugccucaggaaauacaaggacuacugcauccacggggagugcagauaccugcaggaguuccguacucccucuugcaaaugccucccugguuaccacggacacaggugucaugggcugacucuaccaguggagaauccccuauacacauaugaccacacuacagucuuggcugugguggcuguaguacugucguccgucugucuucuugucaucgugggacuucucauguuuagguaccacaggagaggagguuaugacuuggaaagugaagagaaagugaaguugggcguggcuagcucccacugaggaggaccugagcuauaggaaccuucagaggcuacuucugagacagugguucguuacacguucuacauagaggagaaauauuucaccagcagccaugaaaacgucuucauucauuuccaguugcuacccugacugggccuccuguaau

SEQ ID NO: 42 - RNA, 1653 nt, Homo sapiens
ucgaccucacggucuugccaaaaugucgcuuuccaacaagcugacuuuggacaagcuggacgugaaggggaagcgggucgugaugaggguggacuucaacguuccuaugaagaacaaccagauaacaaacaaccaaaggaucaaggcugcuguuccaagcaucaaauucugcuuggacaauggagccaacuccguuguccuuaugagccaccugggccggccugaugguguucccaugccugacaaguacuccuuagagccaguugcugcugaacucaaaucucugcugggcaaggauguucuguucuugaaggauugugugggcccagaagucgagaaugccugugccaacccagcggcugggacugucauccugcuggaaaaccuccgcuuucauguagaggaagaagggaagggaaaagaugcuucugggaacaagguuaaagcugagccggccaaaauugaugcuuuccgagccucacuguccaaacuaggagaugucuaugucaaugaugcuuuugggacugcacaccgagcccauagcuccauggugggugugaaucugccacagaaggcugguggauuuuugaugaagaaggagcugaacuacuuugccaaggcuuuggagaguccugagcgacccuuccuggcuaucuugggaggcgcuaaaguugcagacaagauccagcugaucaauaauaugcuagacaaagucaaugagaugaucauuggugguggaauggccuuuaccuuccuuaagguccucaacaacauggagauuggcacaucucuguaugaugaagaaggagccaagauugucaaagaucucauguccaaagcugagaaaaauggugugaagauuaccuugccuguugacuuugucacugcugacaaauuugaugagaaugccaagacuggccaagcuacuguggccucugguauaccugcuggcuggaugggcuuggacugugguacugagagcagcaagaaauaugccgaggcugugggucgagcuaagcagauuguuuggaaugguccuguugggguauuugaaugggaagccuuugccaggggaaccaagucacucauggaugagguggugaaagccacuucuagggguugcaucacuaucauaggugguggagacacugccacuugcugugccaaauggaacacagaggauaaagucagccaugugagcacugggggcggugccagucuagagcuccuggaagguaaaguccuuccugggguggaugcucucagcaauguuuaguauuuucuuuccugccuuugguuccugugcuccuaagcuaaccugcuguuuuccacaucuccauuugguguuagcgcaagauucagcuaguggcugagauguggcacagaccuuaacagugcaagcaucucagcucgucuuacugcaucagaugcugguucuucaagaucccauuuaaauuccuuagugacuaaaaccauugugcauuguagagggcgucuauuuauauucugccugagaaaggaagugagcuguaaaggcugagcucucucucugacguauguagccucugguuagcuucgucacucacuguucuugacucagcauggcaaucugaugaaauucccagcuguaagucugcagaaauuuccgaauuc

SEQ ID NO: 43 - RNA, 485 nt, Homo sapiens
uuuuuuuuuuuuuuuucauguuuaauaguuuauuucuuauuuuguugcuuauaucuucaauaaaucauuuugcagguuuuguuacagauuuuugauaagccaacucaaguacugauuuuucauccucucugaaaguuuuaaaccaggaaaggaaaacguuccauggaauccaucuuccacauggugaugagucacaugaacuccaacauucugaagccgcuugacauacaugaguccaucaucucuuaggacaucauacuggcaagugaugauauaggucuuagguaaaugaugcaauauauugucauuggccaacagagggcaugccuucacaucuaugaacccuggauacuuuugagccagcucagaacuaccaggagugggauuuuuguaaacgggacuuuucuuguaucucucagggagcaaggaacuccaauucacaaacuguaacaaguggcuagauuccauggguacauguugguuga

SEQ ID NO: 44 - RNA, 3449 nt, Homo sapiens
gagcacccgggacccugggaccacaacgcacuugcucccucucgaccgcgcuccugacccgcagcccucgccaacccuacggauccuaaccaccgccagccuaggugggcgucaggaugaaggcagcccgcuucgugaugcgcagcgccagcucgcugagcagcgccagccugguccccagggaggucgagcuguucucccgcuacagcccguccccgcuguccaugaagcagcugcuggacuuugguucagaaaaugccugugaaagaacguccuuugcuuuucugcggcaagagcugcccguccgccuggccaauauccugaaggagauugacauccugccugaccgcuuagugaacacuccuucggugcagcuggugaagagcugguauauccagagccugauggauuugguggaguuccaugagaagagcccagaagaccagaaagcccugucagaguuuguagacacgcuggucaaaguucgaaacagacaucauaauguggucccuacaauggcucaaggcauccuggaguauaaagacaccugcacaguggaccccguuaccaaucaaaaucuucaguauuuuuuagaccgguuuuacaugaaccgcauuucuacucggaugcucaugaaucagcacauccucauauucagugacucaaagacgggaaacccaagccacauuggaaguaucgacccaaacugugaugugguagcaguaguccaagaugccuuugagugugcaaagaugcucugcgaccaguauuaucuaacaucgccagaauuaaaccucacacaagucaauggaaaauuuccaggccaaccaauccacauuguguacguuccuucacaccuucaccacaugcucuucgaacucuucaagaaugccaugagggccacggucgagcaucaagaaaaccguccuuccuugaccccaguagaggccacugucgucuugggaaaagaagaccuuacaaucaagauuucugaccgaggaggcgguguuccucugaggauuacugaccgccucuuuaguuacacguacuccacugcuccaacaccugugauggacaauucccggaaugccccuuuggcugguuuugguuauggcuugccaauuucucgucucuacgccaaguauuuucaaggagaucugaaucucuacucuaugucagguuaugggacagacgcuaucaucuacuuaaaggcuuuaucuucugagucuguagaaaagcucccagucuuuaacaagucagccuucaaacauuaucagaugagcuccgaagcugaugacugguguaucccaagcagggaaccgaagaaccuggcgaaggagaagcuggcagugugaagcggaugacgccugacauuuuacgggaucaaagugggucuguggcauugcugcuucgugaauguguguggacucuaguuuccgcaaaacaacgcaacacaaaaccaagcaagcaaaacacaaacacgaguacaaaccuugaccugaugagggacagagcuugguuggaugacccgggagaagucagggcagggcuccaggggauaacagguguccugcuucuccuuuggcaaugcaaaaugacuccugacuguuccaaauacugaaaagaagucugccucugaguuacagcucuuucucaacaaguacagaguuugaggcuugcaguugcaacagcuggauguuuggugguucuugcugccagccaaauaaauugguguuuagugaacauuuucaguguuuccccgccaugcaaagcuuggcgccuugggagaaauguguguaaauguacauuguauagguauuagugugcucuagaaaggacaggauggaaggaaucaaagcacuuuaucgagcuuguggcugagcauugcagccuaugugcaaacccagaggaaaaguaucucugucaagacagcuccaguaucaugcagcuuuuuauguuugcacucaaaaagccagugccuucuggcuggugccgaggcuugggugaaauguuaaauaugcacugaccucagaaagucgaguucaaaagggagauaaaauugccaaagugauccaaggauugugcauguugggaaacccauaugagagaaaggauucucauacuuagaacuuuccuaugaagaaauggugguaaacuuucucuaccuagaaguaguggaaauuucaaggucaucuuaaaaaagaugugcguuguauauuuuaacuacauucucuacacucuaacauuaacauaucuauucaaauuugucuaguugccaauugucuucagagugugaaaauuuaaauccuucuugaaguaucuuucgugagaguaguauggaaguaaaacguucucauaucaggaggaugucauuugugaagcauggggacaucaugaacuagugaugugcgugaggcuugggaggcugaaggguaaggaucagcgggaggccauccauguaggagagagaauuaaaacgaggagcgagggaagcaauggagagagggaagcaagaaaggaaccagaaggcuggcaucauccuauuucccacaggcuaacccaagggaugcucugugccuuuccuggggagggaagggggugaacugguagauuugaaagcaguauggcuucuucugugggucucccucuuacuagacaaggugaaaugauaauucgugucaaauuaaugugaaauuuuuuuccugcauuguaauauuaugaggccugagucgcaguugaguuugaaauuuguauuuaauuucacagugaccuagagcuaaggugcucccgguuguggcaauaggagccacaaguauuuucuuucuuucuuucguucuuucuuucuuucuuucuuucuuucuuucuuucuuucuuucuuuccuuccuuccuuccuuccuuccuuccuuccuuccuuccuuccuucuuccuuuccuuuucuuuucucuucucuucuuuucuuuuuucuguuucuuuuucuuuuuuugcauuguagauguuguccuuaaaagaucagggcagugacuuucacagcaggacuuugacucccacauugguugaucacacaaaacugucagcauuuggguaaucugauguauaguuguuuuguugcugauguuuccauugaaauuucagcucugaguuugugcacaugaauacuuacuuguguuuaccaaaggucuaaggcauuugguuacuuaacccaaauauccugaacugugcguaaaguaauagagaaaagcuuuagggucucaauagugucaccuguguaaaucaaaucaaaauagccuucccuauuauuuaugaacccaugggagacuuuaaacucuuguagauagaugcuaaaugcccaggcccacuuaacuuauuaaugugugaauuacauuuauguuuuuaguuuauaugcaaagaauugugauaauuuuauaauaaauauuuuuauuauaauagu

SEQ ID NO: 45 - RNA, 226 nt, Homo sapiens
uuuucuuuuuuuuuuuucuucucuuuuuucugccaccaacagcacugugcaguuuauuaaccauucauguacaguagccaucuggggagauugggacagaauugggaucgcaaaguggauagauauucagcaucuaauggguuggcagaagccgccauauacucuucacaaauaucuuccacagucaauacagaacuagccauuaucccagcacaccgauuugugc

SEQ ID NO: 46 - RNA, 952 nt, Homo sapiens
agccaggagccucgccccgcagcugcacagagagcaaggguauaggcacuaacuuguuugcagagaccccaucaccuucgggagcucaggugcgcaccuugcaaacuccacuuucugcaucugccacugagcccgcgggagccucggaaagagccauggccaacgcggggcugcagcugcuggguuucauccuggcuucucugggauggaucggcuccaucgucagcacugcccugccccaguggaagauuuacuccuaugcuggggacaacaucgugaccgcucaggccaucuacgagggacuguggauguccugcguuucgcaaagcaccgggcagauacagugcaaagucuucgacuccuugcugaaucugaacaguacuuugcaggcaacccgagccuugaugguaauuggcauccugcuggggcugaucgcaaucuuuguguccaccauuggcaugaagugcaugaggugccuggaagaugaugaggugcagaagauguggauggcugucauugggggcauaauauuuuuaauuucaggucuggcgacauuaguggccacagcaugguauggaaacagaauuguucaagaauucuaugaccccuugacccccaucaaugccagguaugaauuuggccaggcccucuuuacuggcugggccgcugccucccucugccuucugggagguguccuacuuuccugcuccuguccccggaaaacaaccucuuacccaacaccacggccuuaucccaagccaacaccuucuagugggaaagacuaugugugacagaggcaaaggaagagaucuuccuggagcaaauacaaaauggacauugaaccuaggauugacauuaacgccuuagacuguugaugaugguuaucggaacugugguagaacagaaggaagcauauuuuuauacauccccauggcuaugcaggccuuggcug

SEQ ID NO: 47 - RNA, 1777 nt, Homo sapiens
cggcacgagcggccacugaccgagaagugcccccgccuggagucagccugggggcaggccaggguccaccagaccccgggaugaccgcagccagucgggccaaccccuacagcaucguaucaucagaggaggacgggcugcaccugguuaccaugucaggcgccaacgguuuuggcaauggcaaggugcauacacggcgccggugccgcaaccgcuucgucaagaagaacggucagugcaacauugaauucgccaacauggacgagaagucacaacgcuaccuggcugacauguuuaccacguguguggacauccgcuggcgcuacaugcugcucaucuucucucuggccuuucuugccuccugguuguuguuuggcaucaucuucugggucauugcugucgcccacggggaccuggagccagccgagggccguggccguacacccugugugcugcagguccacggcuucauggcagccuuucucuucuccauugagacacagaccaccauuggcuacgggcuacgcugugugacugaagagugcccgguggcugucuucauggugguggcgcaguccauugugggcugcaucauugacuccuucaugaauggugccaucauggccaagauggcacggcccaagaagcgcgcacagacucugcuuuucagccauaaugccgugguggcucugcgugacggcaagcucugccucauguggcgcgugggcaaccugcguaagagucacaucguggaggcccaugugcgggcccagcucaucaagcccagggucacagaggagggugaguacaucccacuggaccagauugacaucgaugucggcuuugacaagggccuagaccguaucuuccugguaucacccaucaccaucuugcacgagauugaugaggccagcccacuguuuggcauuagccgucaggaccuugagacagacgacuuugagauuguggucauccuggagggcaugguagaggccacagccaugaccacacaggcucgcaguuccuaccuggcuaacgagauccuguggggccaccgcuuugagccagugcucuucgaagagaagaaccaguacaagauugacuauucacacuuccacaagaccuacgaggugccaucuacaccccgcugcagcgccaaggaccugguggagaacaaguuccuccugcccagcgccaacucuuucugcuaugagaacgagcuggccuuccugaucagagaugaggaggacgaggugucuaccgaccgggauguccgcaccccucagcccgagcaugacuuugacagacugcaggccagcagcgcugcccuugugcggcccuacagacgggagucggagauuugaaugcccuuggcuuagaugcagcaccacccugaccacaauaggucccaugucccuugggggccugcguuugagcagagcaggccgaaagccucgggucacagacucaguagcaucuuagucuuuuucauguuuuuucgcaguagcuugggaaaguuggcgggagcguggauggcccaaaugacuggcucacggccucggaggcugauguauacccaugggcaaggaggugacuucuugggguaggguugcucaggaguuagggacucugcuggaggccuuaggugcaggucccaaccccggugggaggaggcuguguauguacacuucauugguuuuuaacuugggcaagacuguuuacaaaccaaaacaaacaaacaaacaauccaaaaaaaaaaaaaaaaaaaaaaaaaaaa

SEQ ID NO: 48 - RNA, 175 nt, Homo sapiens
uuuuuuuuuuuuuuguuccuuuuuuggaauucccaaagcugguuuuaauuucaaaaaauuaugaggucucuucccacacuggggauaaugggaugggauagcccaaacuauuaucccaguucaaccccagccugguccaaacaccauuacugucacugggcccugucauuucacc

SEQ ID NO: 49 - RNA, 1629 nt, Homo sapiens
uccucguccucgucuguuccaucuucuccaaauagcucuaacugugaugccaacggcaaucccaagaacgcugauaucucuagcaucgaugguguucugaagagugaccgcacagauuguccugugaaaacaggcaaaaccagugcuccuggcaugacuaagagucacaguggaaugacaaaauuuaguggcaugguucuacuguguaaagucuguggggauguggcaucaggauuccacuauggaguucaugcuugugaaggcuguaaggguuucuuucggaggagcauucagcaaaacauccaguauaagaagugccugaagaaugagaacuguuccaucaugaggaugaacaggaaccggugccagcagugccgcuuuaagaagugucugucuguggggaugucacgagaugcuguucgauuuggccgaauuccuaagcgugaaaaacagagaaugcuaauugaaaugcaaagugcaaugaagaccaugaugaacacccaguucaguggccaccugcagaaugacaccuuagcagaacagcaugaucagucagcacuaccagcucaggaacagcugcggcccaagucccagcuggagcaagaaaacaucaaaaacacuccuucugauuuugcaaaggaggaagugauugguauggugaccagagcccacaaggauaccuuucuguauaaucaggaacaucgagaaaacucaucugagagcaugccaccucagagaggagaacggauucccaggaacauggagcaauauaauuuaaaucaagaccaucguggcagugggauucacaaccacuuccccuguagugagaggcagcaacaucucaguggacaguacaaagggaggaacauaaugcauuacccaaacggccaugccguuuguauugcaaauggacacuguaugaacuucuccagugcuuauacucaaagagucugugauagaauuccaguagguggauguucucagacugagaacagaaauaguuaccugugcaacacuggagggaggaugcaucugguguguccuaugagcaagucuccauauguggacccucagaagucuggacaugaaaucugggaagaauuuucaaugaguuuuaccccagcaguaaaagaggugguggaauuugcaaagaggauuccuggcuuccgagaucugucucagcaugaucaggucaaucuguuaaaagcugggacuuuugagguuuuaaugguacgauuugcuucauuauuugaugcaaaggaacggaccgucaccuuucuaagugguaagaaguacaguguggaugaccugcacucaaugggagcaggggaucugcucagcucuauguuugaguucagugagaagcugaaugcccuccagcucagugaugaggaaaugagcuuguucacagcaguuguucugguaucugcagaucgaucuggaauugaaaaugucaacucaguggaggcuuugcaggaaacacucauccgugcacuaaggaccuuaauaaugaaaaaccauccaaaugaggccuccauuuuuacaaaauuacuucuaaaguugccagaucuucgaucuuuaaacaacaugcacucugaggaacucuuggccuuuaaaguucauccuuaa

SEQ ID NO: 50 - RNA, 831 nt, Homo sapiens
auggcguuacuggaucugugcggugccgcucgggggcagcggcccgagugggcugcccuggaugcgggaagcgggggucgcucggacccgggacacuacaguuucuccgcgcaagcuccggagcucgcacuuccccggggaaugcagcccaccgcauuccugagguccuuugguggugaccaggaaaggaauguucaaauugagauggcccacggcacaaccacacucgccuucaaguuccagcauggcgucaucguggcuguggacuccagggccacugcagggaguuacauuagcuccuuaaggaugaacaaagugaucgagauuaacccuuaccugcuuggcaccaugucugguugugcagccgacugccaguacugggagaggcuguuggccaaggagugcagguuguauuaucuucggaauggggaacgcaucuccgugucugcagcauccaagcugcuuuccaacaugaugcugcaguaccgggggaugggccucuccaugggcagcaugaucuguggcugggacaagaagggaccaggacuuuacuacguagaugacaaugggacucggcucucgggacagauguuuuccacuggcagcgggaacaccuaugccuacggggugauggacagugguuaccggcaggaccucaguccugaagaggccuacgaccuuggccgcagagcuauugcuuaugcuacccacagagacaacuauucuggaggagucgucaacauguaccacaugaaggaagacgguugggugaaaguggagaguuccgaugucagugaccugcuguacaaguaccgagaggccgcucuguga

SEQ ID NO: 51 - RNA, 3601 nt, Homo sapiens
auuccaggaguuccagcugcuggagaggacuguguagaagguaaccuaccccaucucucuuacuucgucucuagaugggagcagacaaguacauauagccugcuuggagcgaggacuuugaaaggcugagacuugcguccacucugagggcaacuaguccagacucugacaggucagcauuuccugacugggugcacugaaugccaagcaccagaggucugucaccuuccgacauuggaccaagagagucccagagacccucaaagacacaggaacagagguguccuuugggugagagaccugugcccugccaagccucucagccccuagaaaggcggcagggcugaguagcugagugugugcaacuugggagcagccugauuucagugcuugucaccugugagggcaaaggcagcaugcuuaaugccaucaguccuacucuucucacccguggaacagacgcauaacugaccuuuuuucgugaccacuauuagggugcauuuaaaaaucaaucucucucuuuucugcuccucuuucuccaccuucccucaugugugugucuguguguguguguuucugugugugugugcgugcaccauacagguauaugugccaugacaugugugcaggucaguagacagccuugguugucagucccugccuucuacuuuguucaaggcagggucuauucuuuauuauugacugcuauccagguacaccaagacaguuggccugugagguuccagggagucuccugucucuggcccccaucuuauagcaggaguugugagauuucagaaaugugcacccacaucuagcuuuauuuggcaucuuggcacccaaacuuggguucucaugcuuuccaagcaaggacuucacccacugaaccaucucaccagcuccacuauggcgguuuucugaaacugaagggaguggggagaaggcgcugagugugaacgggucuggaaggcggguauaaccuuuaaggcuggcugguucugagagaggaaagccggcuugugucccauucaggugccaggugcagcaucaaauguggcuccacccaacggucaguaacuccgcagacagcaccgugguuaacugccucacagagggggcccagggaccuaguuccuuaaagcccacuuaguuuugagagacgacauggaggggcaagcccagcccuguccagcugcauucacacgaggcccuucuccuccgaggacccuaccuuuguguuuaguggcugaggcuguguggcucugcuugaagcucuggcuaucaggaaggaccuggcccaccggcuggcaggacaaacuggcccagugaaggcacuguccggucuccugguggaucacaaggaaaggggcguggcauguccagauuugaacccuggaugccucuucccaggguaggaagucuaagggucaacaugaauaggugaggguggugguggaaagaaucugcaugcaaaaucaggcacucaugucugacaucgucaaacacuauauuuauguagauuuauaugggggugaggcuuggggagcacuuguauuuuugugugcaauugcaagagcuuccuccacauugcaguguuaaauaucauauggugcuggaccaaccaucucuggaacgagggugaggguuugguacccgugacuaugguucucuguguaguagaaacggcuucuugggaagagagaggaagugcuuugaaaugcauccucucuuguuucauucugcaucauggccagguuucucugcacaaagaugcaauagacauucaggaaaauaagcgcauugcaagaugucaaaagucaugaaaaaugaaaagcaaggucacugcagcugggguguaguguggcuguagaagcacguuuaugauguacagguuccgggagagggaggaagagagagggagggaaggaggaauggaggaagagagggagagggagcaagagaggggggagggagggaggggagaagggagagagagagagaagaaagagagggagggaagaaggaauggaggaagagagagaaagaggggaagaaagagagggagggaaggagggguggaggaagagagaggugugagggauggagggacagagagggagggaaggagaaauggaggaagagagaaacagagagauggaggaagagagaaaagucaccaauuauuuuucuccccagucgcccccugcccucacaccaaggguacccccacuuuucuuucacucaugcacacacacuacacccaauguuuagguaacacauguagggcaggcagagccuuugugaaugugcuugguaguuuucugccuuacuucuaaauaaccaaucacacggaugccacaggguuccuuuagacuguccagggcuccggggcucuuagacuguucccaaugugggugucacaugcaaacaguaagcaccuucuuguuuguggugcccaggaugcugcagguacuagaaauuccugcacagaccuuugcuacuucuacacagacuuacccuuuaaaacauuuaauuauauguuuuuuucagcauaaagaucuauuuugauuauuuuuaguugcguguaugggugugugccugugugugauuguguaauugucuguaugggaguguaagugccuacagaggcaucggauccccuggagcugccguuacaaguaagggacugggacucagaccugagugguuuggaugagcagugaaugagcguggugagccaucccaccaugcccuauaaacacuuucaagaggacuuugcuggguauggucaaguugucccccugcgacagccaccccaacuugccauccucauuuacuguacuggaagcagcaaccaccucugcaauuuugcacaagaaccugagagucugaaagacuuuuguuggcacuggccuguguuccacugggguggacacauuaaucuaaaagcuaagaagcucacuucagcuuugccaggcaaccagcacguuugagcacaacgguguagccaggaagggugugugggaauuuugaugcuaguuuuucuuuaauuagguugagagugaaaucauggucuguaugcauccaacaacuuaauccaaaaaguugguugcacggcuccuggaagguuuaccggcaaggaaccugucccauuuuguaaguaggugggacuggagaguugccaagaagccccccucccugcccccuuccuccuggcagauucugcuuaaaaugagugugguucacugcagaauagugucaccugucuucagaugucuaaagacauaagaaaggccuagccagcuaagucagaaaaggggacuuuccggugggaaugcauuuuccagucucuaggagaagucuuuauccaaauaaaauuagcauagugguggagucacugccagggcgcuggugcggaagcacagcccagagccgaggacguggccauccuccuuccucugaugcaaaguguucucuauccccaguuaccaugagcaauaucaguagcaucgugaaccgggcccgugaugccuuuaacucaggcaagacucgaccgcugcaguuccggguugagcagcuggaggcguugcagcgcaugauc

SEQ ID NO: 52 - RNA, 329 nt, Homo sapiens
uuuuuuuuuccaaaaaauuuuauugggggaaacuacaaaacauuuacaguacaauguuuacagucacaauuuguagugaacugauuccccaaaauauauuacaacucaaguugacuuaaucuuguuacauucaaaaaccuacuucugucaaaguaguccagagugcacacgcggugcuccaacuguaccuacauacaaacuaaacaacugcucauuuaucugccauccaggaaagccggagacauuccugccucuuuacauugaaaaauaauaguacaaguuuuuggacugucauugaacaaggcauauucauguaccaccaacauuuc

SEQ ID NO: 53 - RNA, 3671 nt, Homo sapiens
ggugauccuccaggaccuaagguuucgguauuaucuucggggccucuucacccggaggugagucugcugagcccgaccucagguguucacucgucacgcgagggccuggccacggcggggaagcacugggagagagcgggaggccuugaccgcagcguguaggaucuggggucccggcgcucugcucccgggugcagagugguuggagcaugcgaggcccucugcagcgugcucuguuccuaccaucaccccacccccaccccaguccuuccugcacguuucuggagaggcaaaggccccugcugagccuucacuggguaccccuaucucgacuccacuugucugcuugggaucuccaaagggggauacacccucguaaacuagagcaggaggcugggggguggggguagggguagggucugaccaguuagauugaggcuggacccuccccagagugaggagcgggaagcucuuugucuuauccaggauuuugcauaucaaugcugagguucuggugauuaaguagggucccuggcuagcggggguaaccugaacaaccuuccuccgcuggccgcuagccaauagacaccuggcuuccgcggaugagcccuuugaguuuguggagguguuccucagguccccagggcccugccccguugccugcagauguguggacagacaaaacauuggacucguuuuccaaccacuucaccccuuccuucgcuaguccuccgguggacgaugggaugccucauugacuuguuuguggcugugcaugccagagcuuccuagcagacagcucagggcuccaucguuccuaaaucccacuguguaacgaaaaaaaaaaaaacaaaaacaacaacaacaacaacaacaaaaacaaaaccagaaaugaggacaggcccagcugggcuuggcacugaacuuggccaccuggagcuuuggcuacccacuacaagaugucagcaagucucaggauagaagaggccuaaggccaguccuggaagauaccaaaacuucaccuccucuauaccccguuccucuaggagaacuguaagccaccuuugucucugggacgccccucucccacucaacagauggcaccagucaucuuccuccucaagaggccagugguauucaaaauaggauauugaaaccaagcaagcugguccucuccucuacccuaugccaaagacuucugcccaaagggcccagaaaagucccauagccaucuggcuggcuagugugcugacugcuacaggugucaguguccccagcgagcagguaguggaguggaggugucuucuuguggaaauggguccugagccucuaccuuguacagaaaggaauuagugaagcccagaggccuccagcccgugucucugccacaagagagaggggguggggguggggcuguauuugguucccagggcucagggaagguuuucgguucaugcaugcucauuuaucugaccacugucuuaaccccaggacaaccacuuaacuguccacuuccauaucagaguucuugguuccccuuuacuucgucuauggagccccugaguuugggaagggguauuaacugaaagguaccauuagaugaacuuggagaaagauuuguaggugccacgggagauuucagguaaaagcucuuuuaauaauuggcuacaauagcagcaggaggaggccaggaauucugagguagagauuugauuagcagcacguggagcaaaggagacuucugacuccuacagguuucagaaaguggggagaggcucucagaugaauggcuuggacugugagguaaguguuaguguagcacgagacuagcuuaaggcuguacaaauuguccgucugauuggugcauugggccagguagacacuagauaagcaauugggccuuaacucgaguugucuuaauggcuacccccagggcagcagggagucaauacugcucuccugucuggggccugaaugcugaaaccaucuacaaaggggacauaaggcauauuggggagguguagagugggccaggcccagggucugcugguaucuaugccaggauccugaguggugguggcguagccugucuuuuaaccaacugccucucucacaguaggcuucuuuggcuugcgaaccuucagcagaugucugccacuuccaacaugagagucuuccugccugugcuguuggcagcccuucugggcauggagcaagguauggagcucugagauaacccugcagccugguccuccuccugaucucucauucuuucuccugaguagaugcccagggcuccuccugagccagcccuccuaggaacgucuggccuucccaccuccuacucucuagccaacugaccuaguuccccugaugcugugcuggcccagcuacaccuuugucaccucguguugacuuuagccacuccaguaccaaagucugaagucaguugucauuggcuggcuuuuuucccugacccagggcugagcaugcuguugcuucuugucaguggguuggggaucaagggccccacuggaaagucaccuuacccuggaaggcuuccccaggcaauaggcaggugucaccuacagcauugucccuuuugcaguucauucccugaugugcuucucauguaccgaucagaagaacaauauaaacugccuguggccaguuucaugccaggagaaagaccauuacuguaucacguuaucugccgcugcgggcuuuggugaguagcugccuguuucccuagccagggccagggaccugcggggcuuuccccauuuccugcuacccugucugucuguccccucauccucacuuuccaugcagggaaugucaaccuuggcuacacccugaacaagggcugcuccccgaucugccccagugaaaaugucaaucucaaucucgguguggcguccgugaacagcuacugcugccaaagcuccuucugcaacuucagcgcagcuggccucggacuucgugccaguaucccacuacugggccuuggacuccugcuuagcuuguuggcucugcugcagcugagccccugaccaucccccauguguucuccauauccccccagcucaggaaaagcccagcuccuuuuaggucccaggggacccuaggaaccuucagcuccuccugggugugucuaguucccccuccacacucucucaacgucagggcuaaguaccaaacucacccauaccugcucuguugaagugguacuggcuacccuugcuuccagagccaauccuauaaccucccuuggggaaccagcgaaggggugaagaucuccuuggagucucaagaguaccagagucagcgccgaaucuuguggacacacugacaaggaugucuaauccaaauagauguauaucugugugcucaguguaucccugugugaaugaagccacuuggauucuggggugggcaaagaagaccugaaaagauucuacagcagaaggccugugucgccaccaaaaccccucccccugguaucauuguacccaccuuguacucuguucaggaggcugcccauggaggacugccaccccuccagaugaaggcucccacuacccgaugcaguugagucccauccugcccucucugcccacacuggcuuccugcugcuauucuagugccucaaauaaaccguucacacccuu

SEQ ID NO: 54 - RNA, 951 nt, Homo sapiens
cuuccucccucuacagaagaagagcaagaagaugaggaagaaauugauguggugucuguggagaagaggcaaaccccugccaagaggucggagucgggcucaucuccauuccgaggccacagcaagccuccgcacagcccacugguccucaagaggugccacgucuccacucaccagcacaacuacgccgcaccccccuccacaaggaaggacuauccagcugccaagagggccaaguuggacaguggcaggguccugaagcagaucagcaacaaccgcaagugcuccagccccagguccucagacacggaggaaaacgacaagaggcggacacacaacgucuuggaacgucagaggaggaacgagcugaagcgcagcuuuuuugcccugcgugaccagaucccugaauuggaaaacaacgaaaaggcccccaagguagugauccucaaaaaagccaccgccuacauccuguccauucaagcagacgagcacaagcucaccucugaaaaggacuuauugaggaaacgacgagaacaguugaaacacaaacucgaacagcuucgaaacucuggugcauaaacugaccuaacucgaggaggagcuggaaucucucgugagagcuaaggagaacgguuccuucugacagaacugaugcgcuggaauuaaaaugcaugccaaagccuaaccucacaaccuuggcuggggcuuugggacuguaagcuucagccauaauuuuaacugcucaacuaaauaguauaaaagaacuuuuuuuuaugcuucccacucuuuuuucuuuuuccuuuuaacagauuuguauuuaauuguuuuuuuaaaaaaucguuaaaaucuauccaauuuuccauguaaauagggccuugaaauguaaacaacuuuaauaaaacguuuauaacaguuacaaaagauuuuaagacauguaccauaauuuuuuuu

SEQ ID NO: 55 - RNA, 1822 nt, Homo sapiens
gugggacgggccccccucgaggucgacccacgcguccgggaguacccccgaccuuggcugcgugcugacucgcuuccuucugccugcccaggcuugcacuccccggggaucugccucugcaucucuugccuucgcuguuguuucccucucuguccagcuccccucccgcucucgcccuggagaauggcucagaaggagaacgccuacccguggcccuacggcucaaagacgucucagucuggccugaacacguugucccagagaguccuacggaaggagccugccacgacaucugcgcuugcucucgugaacugguccaacagccaguccacagcugccccuggccagaaguuggcugagaacaagagucagggcuccacugccucgcaaggaucccagaacaagcagccuuucacuauugacaacuuugagauugggcguccuuugggcaaaggcaaauuuggaaacguguacuuggcucgggagaagaagagccguuucaucguggcacucaagauccucuucaagucucagauugagaaggaggggguagagcaccagcuucgccgagagaucgaaauccaggcgcaccugaaacaucccaacauccuucaacucuacaacuacuucuacgaccagcagaggaucuacuuaauccuggaauacgccccucgcggggaacucuacaaggaacugcagaagagucggaccuucgaugagcagcggacugccacgaucauggaggaacugucagaugcccugaccuacugccacaagaagaagguaauucacagagacauaaagccggagaaccugcuguuaggucugcagggagaacugaagauugcagacuuuggcuggucggugcaugccccaucccugaggaggaagaccaugugcggcacgcuggacuaucugcccccagagaugauugaggggcgcaugcauaaugaaaugguagaucuauggugcaucggggugcucugcuaugaacugaugguggggaacccccccuucgagagcccuagccacagugagacguaucgucggauugucaagguggaccugaaguuccccucuucugugccuucgggcgcccaggaccucaucuccaagcugcucaaacauaaccccuggcaacggcugccccuggcggagguugcagcucacccuuggguccgggccaacucaaggaggguucugccucccucugcccuuuagccugcuccuugguuuuuugucccugucauuuuucaguguucuuuguaugucuguguauguguucugagaaggggugggaacuggaaacuauuccuagcuccaguucuaggggaucugaucucucuucugaccucuacaggcaaaauuaggcaccccuguggugcacauauaugcacgccaaacacaugaaguuacaaacaaacaacaaacacacagauagugcuggagagauggcucggcaguuaaaagcacuggcugcucuucccaggaaccuagaacucaauucuagcacuacauggugcucacggccacugucuguaacacccaguccuggggaaucuggggccuucgagccucugcaggcacuaggcauggaugugguauacauguaugcaggcaaaacacccaugcacugacuuuuaagaaacccucuagucugauuccuuucaauuugucaaauguugaauguuauuuuuaaaauauuauaagccauuuaauacaauuuuucuuugaaacaugguauagccuagucugucuuaaauucagaaaaauuaugaagaacaacauuuuauaauaaagucuuaaauguuucauguuuuug

SEQ ID NO: 56 - RNA, 2663 nt, Homo sapiens
uugccuaggaagggcgcgucgucucucugcucguccggcugugacggggaagggucccgcugcguuuuggucacugugaguaccaaguuugggggauccccgagggacucucgagagcucauuuuagggaugcaggggcuacuccccggugguagagagcuuucuaguuggcaggagguuucguauguggaggaggccagcuuaggcagaaagcacauguucucagagaugaggacaagacuaagaccgucuaaucccugaucuuuaccuuccggcccgcugaccugggccuggaugcuaaagcccucugcuuucgucuaaacagcgcuaaauaguaaacaguauugccuaagauaaaugcggauuauuacccgauucagugucgggaaaaggcagcuaggagagagcggcuggcacgugguaagcacacgguaaguuucgguuaaauuaaaacaaccauccguugagcaucucuuagcaagcuccuuccacccuucaaacaaucagugauagugcgucuguuucacugauuagggagcuaaggcuccaacagcagcaaaggaacuaauccgccucugaucaacauggcguuucuuacagggcauuccuuauacgcuuucccacgugcguaacaggaaucggguguucccggguuuuguuuuguuguuguuguuuuuguuuuguuuucuuagugaaagaggcagggugggcuccaggccgcugaggauuaauaaagagauucuaugaggaggaaauaacaggcaggugguaugaucgaggcaaggcccugaggaaggcuuggguggggugaguagaaccagagccggaaguccacucagcagccuggggcacuuaaagcuucugcuggggcaaaugguaaggcggcguaaggucacauuccuuucauuucuuccagacucaggaggagaccacaccuuccggagaaccaggccugaaccgagguacuauuuuguagcucucagaagccaggacucugcaacacuguuugcugccuguggaucuucuauauucacagugucccaguugcuucugaucuaccacuguuagauacuucugccacccauccuaagaguauaguuguucuuggaaaggagucucagcugcugucagcaggagucccucauucgacuccugugguugcccuuuccaccaugccaaagaauaaaggcaaaggaggcaaaaacaggcgcagagguaaaaaugaaaaugaaucugagaaaagagaguugguguuuaaagaggaugggcaggaguaugcucaggugaucaaaaugcugggaaauggacgguuggaagcaaugugcuuugacggugugaggaggcugugccauauaagagggaagcugagaaagaagguuuggauaaauaccucggacauuauauugauuggucuacgagacuaucaagauaacaaagcugauguaaucuuaaaguauaaugcagaugaagcaagaagucugaaggccuauggagaacuuccagaacaugccaaaaucaaugaaacggacacauuugguccuggggaugaugaugaaauccaauuugaugauauuggagaugaugaugaagacauugaugacaucuagccugaccuaagcaugcuaccuuccaaguucucugaagauagcuccacacaguggcaucuugaccuucaucuguuaaguaaaacuucauggcauguguaugacuuguuaaugcaagcuaaugaauuuuauuuuuugaaguacuauauuucuuugaaaaccaaagauguugaguuaucaucuuaagugacauguuaacacuuugugcuuuugaauauaauugaaccuagcgcacagcagugagcacuguuaagagacugccuuuccauuuguagcuucauuucuggcacgggaguguuuugugucagcaguucugccagguggccaucgaugagcugaaguaaguccuaguccagcacaucugcuucaggccuuuguacucuagucaucuggcugcguucgagacuucucagcagaacuuauagauguguacggcugcacuuggagucagacaagauauggcuacuuuuguacuuauggagccaugccauuuuauacuuucacguuguauacauucguuugacccuuuaaguuguugccacccauaaaaaggcaucuuacagugcaguuuuuaaauuacauggguagcaauuuugaguuuuaaaaauuagucauugcagaaauuaaauacuuagaggagauaauccauuaucuugauuuuaggaauauaauaguugacaauguuuauauauaauuuuacuucucuaaggcauacccaaaaauagaaaaugaaaaagagcagugagucuguucugaugcuugcauugcauagagaaguuuuccaacaaagcagcuguuaauaacacauaaaauauguuuuacuuugcaaaguagguuguguuaagucauuuucaaaaaguuaccuacuauaucgaggcucuggauaauuacuauguguugauuaaaguuaguuacagaauuguacaagcuaaguuuuccuuaaacuaagcuuagguuaaagggagaggagccacagcucaaugaaaacacgguuccuguuuucuaaauggaggcgcccagaaacacaauaaaacauguugguacaaaaaaaaaaaaaaa

SEQ ID NO: 57 - RNA, 884 nt, Homo sapiens
caugaucccagccacccgcucgcuucucugugcagcgcugcugcugcuggccaccagccgccuggccacaggggcgccuaucgccaaugagcugcgcugucagugccugcagaccauggcugggauucaccucaagaacauccagagcuugaagguguugcccucagggccccacugcacccaaaccgaagucauagccacacucaagaauggucgcgaggcuugccuugacccugaagcucccuugguucagaaaauuguccaaaagaugcuaaaagguguccccaaguaacggagaaagaagacagacugcucugauggcaccgucuggugaacgcuggcuucugacaacacuauacaauuucuuuugaggguccuauuuauuuauguauuuauuuauuccacaaagugugugguuuuuauuuuacauuaauauuuaacaguguggauacauuucaucgaugguaguucaguucugcuuguucaguuuaaagaugguaggcuuaaaauauuucauuaaaacuaauauuuauugggagaccacuaagugucaaccacugugcuaguagaaggguguugugcgaaaagaagugcagagagauagaguuuaguauuauguuuuguauguauuagggugaggacaugugugggaggcuguguuuguaugucuugaaaagaaugucaguuauuuauugaaagucgucuuucauauuguauggucaacacgcacguguugacgcuucccuuggacauuuugugucuaguugguagcccauaaugggcuuuuacauucuuuaacccuguuucuccuggucucgucucgcucgggacagagacguucaaaggacuguuacaaaugaaguaaaaauaaaaguuuuauuaag

SEQ ID NO: 58 - RNA, 1310 nt, Homo sapiens
cgucucccgcauucgucugggccgugcaccugcccgcuagcucgcugcacuaccguugcccacaagccaacaugcugccgagauugggcggccccgcgcugccgcugcuccugccgucguugcucuugcugcugcucuugggcgcgggcggcugcggccccggggugcgcgccgaggugcuguuccgcugcccacccugcacgcccgaggcucuggccgcuugcgggcccccacccgacgcgcccugcgccgagcuggugcgagagcccggcugcggcugcugcuccgugugcgcacggcaggagggcgaagcaugcggcgucuacaucccgcgcugcgcccagacgcuacgcugcuaucccaacccgggcuccgagcugccccugaaggcgcuugucacaggcgcggguaccugugaaaagagacgcgugggcaccaccccacagcagguugcagacagugaugacgaccacucugagggaggccugguggagaaccacguggaugggaccaugaacauguugggaggugguagcagugcuggccggaagccccucaagucaggcaugaaggagcuggcuguguuccgggagaaggucaaugaacagcaccggcagaugggcaagggugccaaacaccucagucuggaggagcccaagaaguugcgcccgccucccgccaggaccccuugccagcaggaguuggaccagguccuggagcggaucuccaccaugcgccuuccggaugaucggggcccccuggaacaucucuacucccugcacauccccaacugugacaagcauggccgguacaaccuuaagcagugcaagaugucucugaacggacagcgcggggagugcuggugugugaaccccaauaccgggaagcccauccagggagcucccaccauccggggagaccccgagugccaucucuucuacaacgagcagcaggagacugguggggcccaugcccaaagugugcaguaaaccccagccagucggugccuggcuuccccaucccgaacaccagcagaaauggagggcgucagggugacggguguggaggaguucccaguuuugacacauguauuuauauuggaaagagaccaacacugagcucagaagccccccucugaccccccccagcggcuguuaacugaaccucccuugcuucuguuagagaggggaagggugguauggagggcacuggguacaggccugggaauggggaaagaaauuuuuauuuuugaaucccugugucucuuuuacuuaagauuaaaggaaggaaaaauaaaaaaaaaaaaaaaa

SEQ ID NO: 59 - RNA, 487 nt, Homo sapiens
gaugugaaaaacguuuuuauuauaaucucuuaaacuuucaguguauauuuucauuacaaucauugguacaauaaauauggaaaugcugagcagacaauuaucacaguggccuaugggcugagggacagggacccaggaauacuguuacccuggauacuuccucagggccaaucaggaggucuucaaagaguauugagagggagagggauagaaauauuauuaagacugucagugcagcaacuuuuagaaugucuauuaaagccauggauacaggauuuacgauaacagaagauggauacuaaaaaagaacagagacucaaguucuccuguaagaggcagaagaaacauugcagaagccagugccuuccucggguccccagugugugcccccauccacccacgcauuguguuggucaucuccaccugcccugugcccagcccugugcccacccagguucuccuaggcacccaccuugcaccucgcacg

SEQ ID NO: 60 - RNA, 1430 nt, Homo sapiens
gaauucugcgcgguuuugcauuuuuugggucagauuggcuuuuuacaugauuacgaagcuccaacgacuagaccacagggaccgucgccuuggcggccgagcagucguauccaacuuggagacagccaguucgccgugugucugucuguccuucaucgcagucauggagagagccagucugauccagaaggccaaguuggcugaacaggccgaacgguaugaagacauggcagcuuucaugaagagcgccguggaaaagggcgaggagcucuccugcgaggagcgaaaccugcuuuccguagccuacaagaacguggugggcggccagagagcggccuggaggguccuguccagcaucgagcagaagagcaacgaggaggggucagaagagaagggccccgaggugaaagaguaccgggagaagguagagaccgagcucagaggugugugcgacaccguacucggccugcuggacucgcaccucaucaaaggggcuggagaugcagagagccgcgucuucuaccugaagaugaagggugacuacuaccgcuaccuagccgagguggccacuggcgaugacaagaagcgcaucaucgauucugcccggucagccuaccaggaggccauggacaucagcaagaaggagaugccgccuaccaaccccauccgccugggccuggcccugaacuuuucagucuuccacuacgagauagccaacagccccgaggaggccaucucgcuggccaagaccaccuucgacgaggccauggccgaccugcacacccucagugaggacuccuacaaggacagcacccucaucaugcagcuccugagagacaaccugacgcuguggacagccgacagugcuggggaagaggguggugaggcuccggaugacccccacaucugaagcagcggaaaaacaacccggguuggcuuggccuuccaguccccagccuggcauagaggauuaaaagggagugggauuuugccuuucccaaacccugaauguucagcaacaccuugggaaggucuuucgaagggggcgcagccaagcugaagccaccagggcagggaauuuaauuuuucguguagcuguuuggguggguguuucccaaaaccaucccaccccuguuuuuugaacccccuccccaauucuucccccugagccucccucgggcaccuguugcuuuuggauccgaauaauccaggagguuccccacccuguggcugagaaauggacuguggcaagggcugugugugugugagagagagggaaacucugugugugugugugugagagagagagagagagugaaugagagggaaaaaguuugcugggugugaccaugguaccaaucaauaaaguugcccugugagacucaaaaaaaaaaaaaaaaaaaaaaaaaaaaaaaaaaaaaaaaaaaaaa

SEQ ID NO: 61 - RNA, 268 nt, Homo sapiens
uuuuuuuuuuuuuuuuuaaauaccaaaacauuuaauugaaauaccuguauaaaaaauaugaucuucagacauuucacacuuuugaacuuauacaaccccaccccugaugcuuagucacaccagggucacagaaacacagcugcuaaaauaaauuaagggcuugagacucugucccccaaccccagcuuucagagccagcaagcagacuguacaaggucaauaauuuaaaccccuccccagcgcagagugcucagggugacagggucuc

SEQ ID NO: 62 - RNA, 377 nt, Homo sapiens
uuuuuuuuuuuuuuuuuaauguaacgaccggugugcuucaguuuguuuagcagaaccacucucuugaaucacauuaacuuuugagauuuaaaaaaaacaaaacaaaaaaaaaaaaaaacaacaaaaaaaaaaccaacccuccauagcacagcugucuuuuaugcaagcaagagcacaccuacuccagcaugauuugucaucuaaagacuugaaaacaaaacaacaacaacaaaaaguuacuuauagucaauggauaagcagaguccgaauuuacacuaaucaagacagaccuucgaggggucacgauaaguccggaacuuucaaaccuugcuucguaugaauuguacuaucugaacauaaacugcacuuuuauuuuc

SEQ ID NO: 63 - RNA, 756 nt, Homo sapiens
augagacuccacagccucauccugcucuccuuccuucuccuggcuacucaggcguucucagaaaaggucagaaagagagccaagaacgcaccacacagcacagcggaggaggggguagaggguucagcucccucguuagggaaggcccagaauaagcagagaagcaggacaucuaaaucucugacgcauggcaaguuugucaccaaagaccaagccacaugcagaugggcugugacugaggaggagcagggcaucagccugaagguccagugcacacaagccgaucaggaguuuucuuguguuuuugcuggugacccaacugacugccuuaaacacgacaaagaccagaucuacuggaaacagguugcccgcacgcugcgcaaacagaaaaauaucugcaggaacgccaagagugucuugaagaccagagugugcagaaagagauuuccagagucuaaccucaagcuggugaaccccaacgcacguggaaacacgaagcccaggaaggagaaagcagaggucuccgcaagggagcacaacaagguccaagaagcugucuccacggagccaaacagggucaaagaagacaucacacucaauccagcugcgacccagaccauggccauuagagauccagagugucuagaggauccagaugugcucaaccagaggaagaccgcccuggaguucuguggggaaucuuggagcuccauuugcacauucuuccucaacauguuacaggcgacaucaugcuaa

SEQ ID NO: 64 - RNA, 4701 nt, Homo sapiens
cgggucgacccacgcguccgcccacgcguccggcggagcuucuggguugcgggccgaaacggcaagcggauggagggcgcucgaacggccaggugucgugauuaaauuagucagcccucagagacaggcguccuaccuccuuuauccagaccucaaaagccccguugugcacccgugguggcuucuucaccuucccuguuucguccuccacuguauggcccagacaugagugguccccuagaaggggccgaugggggaggagaccccaggcccggagaaccuuuuuguccuggaggagucccauccccuggggccccgcagcaccggccuuguccaggccccagccuggcugaugacacugaugcaaacagcaauggcucaaguggcaaugaguccaacggacccgaguccaggggcgcaucucagcggaguucucauaguuccucuucuggcaauggcaaggacucagcucugcuggagaccacugagagcagcaagaguacaaacucacagagcccauccccacccagcagcuccauugccuacagccuccugagugcgagcucagagcaggacaacccaucuaccaguggcugcagcagugaacagucagcucgagccaggacccagaaagaacucaugacugcacuucgggagcucaaacuucgacugccaccagagcgucggggcaagggccgcucugggaccuuggccacacugcaguacgcucuggccugugucaagcagguucaggcuaaccaggaauauuaccagcaguggagucuggaggagggugagccuugugccauggacaugucuacuuacacccuggaggaauuggagcauaucacauccgaauacacacuucgaaaccaggacaccuucucuguggcuguguccuuccugacaggccggauugucuauauuucggagcaggcagguguccugcugcguugcaaacgggauguguuucggggugcccgcuucucagagcuccuggcuccccaggaugugggugucuucuauggcucuacuacaccaucucgacugcccaccuggggcacuggcaccucugcagguucaggucucaaggacuucacccaggaaaagucugucuucugccgaaucagaggagguccugaccgggauccagggccucgguaccagccauuccgccuaaccccauaugugaccaagauucgggucucagauggagccccugcacagccgugcugccuacucauugccgagcgcauccacucugguuaugaagcuccccggaucccuccugacaagaggaucuucaccacccgacacacaccaagcugccucuuccaggauguagaugaaagggcugccccacugcuggguuaccuuccccaggaucuccugggggcuccaguacuucucuuucuacauccugaggaccgaccccucaugcuggccauucauaagaagauacugcagcuggcaggccagcccuuugaccauuccccuauucgcuucugugcucggaacggggaauaugucaccauggacaccagcugggccgguuuugugcaccccuggagccgcaagguggcuuucguguugggucgccauaaagugcgcacggcaccccugaaugaggacgucuucacucccccagcccccagcccagcuccgucccuggacucugauauccaggagcucucagagcagauccaucgauugcugcugcagccugugcacagcuccagccccacggggcucuguggaguuggcccucugauguccccugguccucuacacagcccuggcuccuccagugauagcaaugggggggacgcugaggggccugggccuccugcuccagugacuuuccagcagaucuguaaggaugugcaucugguaaagcaccagggacaacagcucuucauugaaucucgggccaagcccccaccccggccccgccuccuugcuacagguacauucaaagccaaaguccuucccugccaguccccaaaccccgaacuggagguggccccaguuccugaccaagccucguuagccuuggccccugaggagccagagaggaaagaaaccucuggcuguuccuaccagcagaucaacugccuggacagcauccucagguauuuggagagcugcaacauucccaguacaaccaagcguaaaugugccuccuccuccuccuacacugccucuucagccucugaugaugacaagcagagggcagguccaguuccugugggggccaagaaagauccgucgucagcaaugcugucuggggagggggcaacuccucggaaggagccaguggugggaggcacccugagcccgcucgcccuggccaauaaggcagagagcgugguguccgucaccagucaguguagcuucagcuccaccaucguccaugugggagacaagaagcccccggagucggacaucaucaugauggaagaccugccuggccuggccccuggcccagcccccaguccggcccccagccccacaguagccccugacccaaccccagaugcuuaucgcccagugggucugaccaaggccgugcugucccugcacacacagaaggaagagcaagccuuccucaaccgcuucagagaucuuggcaggcuucguggacuugacaccucuucuguggcccccucagccccuggcugccaccauggccccauucccccuggucgccgacaccacugccgaucuaaagcaaagcguucccgccaccaccaccaccagaccccccggcccgaaacucccugcuaugucucccauccuucaccugugcccucuucuggacccuggccacccccaccagccacgacccccuucccagcaaugguccagcccuacccacucccaguauucuccccucgaggaggaccccagccccuucccccugccccuacaucuguguccccugcuaccuucccuucucccuuagugaccccaaugguggccuuggugcucccuaacuaucuauucccuaccccaccuaguuauccauauggggugucccaggccccuguugaggggccacccacgccugcuucccacucgcccucuccaucccugcccccaccaccucucagccccccccaccgcccagacuccccacuguucaacucgagaugcagcuccccacuccagcucaaucugcugcagcuugaggaguccccccgcacggaggggggcgcugcugcaggaggcccaggaagcagugcugggccccugccucccagugaggagacugcugagccagaggccagauugguggagguuacugagucguccaaucaggaugcacuuucaggcuccagcgaccugcuggagcuacugcuccaagaagacucucgcucgggcacaggcuccgcagccucaggcucccugggcucuggccugggcucugggucugguucaggaucccacgaagggggaagcaccucagccagcaucacccgcagcagucagagcagccauacaagcaaguacuuuggcagcaucgacucuuccgaggcugaagcuggggcugcucgggccaggacugagccuggggaccaggucauuaagugugugcuccaggaccccaucuggcugcucauggccaaugccgaccagcgugucaugaugacauaccaggugccguccagggaugcagccucugugcugaagcaagaccgggagaggcuccgggccaugcagaaacagcagccacgguucucagaggaccagaggcgggaacugggugcugugcacuccuggguccggaagggccagcugccucgggcccuugaugugauggcguguguggacuguggcagcagcguucaagauccuggccacucugaugacccgcucuucucagaacuggauggauuggggcuggagcccauggaagaggguggaggcgaggguggugggugugguguuggcgguggugggggugaugguggugaggaggcccagacccaaauuggggcuaaggguucaagcucucaggacucugccauggaggaagaagagcaaggugggggcucauccagcccagcuuuaccugcagaagaaaacagcaccagcuagauccauuuuggggccgcuuacagcagucuaaugagaggcuuccuuucgaccauguugggguucuuauaacucaagauacagcuggaccaaccaauaggaaacugccccagcuucucccaacauagggggcuggacccccauuaccagcccaggcacaggagcugccucuagcuucuuagcagaguggaaguucucagccccauuuggaggauuguccacgcccgucccacugaggagacgggcgggucuucgguuaagguugcugacaagcugcugaaguggucuguccaaaucccagcugagccugagucccagucgcaggguuggggcugcacuuauuuauuugggagagacagcucacucucccaccucaccccaagaugggaggaggggaaccugggaucuguguaggauccagguccgugaaccccuagcugcuccagggugggggagguugguggaccauggagucccuggugcugccccucaggugggacccagguguucucagcucuacccucuaccaaugacauuuguguuuuugauauugugucuguuauuuuuuuuuuaauacaaaaugacaaaaugaaaaaccaaaaa

SEQ ID NO: 65 - RNA, 3036 nt, Homo sapiens
gacagcggagcgcgguggcgucgacgucuagugucucagugcucccgucuguggcuaacuaagcagccagcagccaggcagcucgcgaccugcggccaggcagccaaccaugcucaacuucggcgcuucucuccagcaagcuucggaggggaaaauggaacuaauuucugaaaagcccagagaggggaugcaucccugggacaaagcugagcagagugacuuugaagcgguggaagcgcucauguccaugagcugcgacuggaagucucauuucaagaaauaccuugaaaacaggccugucacaccagugucugauaccuccgaggaugacagcuugcuuccagggacgccugaccuucagacagucccagcauuuuguuuaacgccaccuuacagccccucugacuucgaacccucccaagggucaaaucugacugcaucagcgccaucuacuggccacuucaaaucuuucuccgaugcugccaagccuccaggcgccacuccuuucaaagaggaggaaaagaauccuuuagcugccccuccucuuccuaaggcucaagccaccagugucauccgucacacagcugaugcccaacugugcaaccaccaguccugccccgugaaagcagcuagcauccucaacuaucaggacaauucuuuccggagaagaacccacggaaauguugaggcuacucgaaagaacauacccugugcugcagugucaccaaacagauccaagccugagcccagcacaguguccgauggugaugagaaggcgggcgcugcacuauaugacuuugcugugccuuccucagagacaguaauuuguaggucucagccagcuccuucguccccagugcagaagucaguacuggugucuucaccuacaguauccacugggggagugccaccccugccugucaucugccagaugguuccccuuccugccaacaacucucuuguuagcacaguuguccccagcacuccuccuagccagccaccagcugucugcucaccuguguuguucaugggcacucaggugccugagggcaccgucguguuugugguaccccagcccguugugcagagcccaaggccuccaguggugagccccaguggcaccagacugucucccauugccccugcuccuggauucucuccuucagcagcaagggucacuccucagauugacucguccagaguaagaagucacaucuguagccacccaggguguggcaagacuuacuuuaaaaguucccaucugaaggcccacgugaggacacacacaggggaaaaaccuuucagcugcagcuggaaaggcugugaaaggagguuugcucgcuccgaugaacuguccagacaccggcggacacacacaggugagaagaaguuugccugucccaugugugaccgucgguuuaugaggagcgaccauuuaaccaagcaugcccgacgccaccuaucagccaagaagcugccaaacuggcaaauggaaguuagcaaguuaaaugacauugcucugccuccgaccccugcuuccgcacagugacggccagaagauggagacgcagaauaaacuuuggucagagucaggagccagugauggugucaagugcuucugcaaggcuguggcccuccaaaagggccuaaaguagaagcccuggccugggggaggccccgccugggugaaaugacaagaagugcuucagccacaggcaggucacagaggacagggcucaguucuuaccacagagagagaggagaacccuuuuauuccucccuuauuuuagucuggaaaguuucggcugaggugagcgcagcacagguuuugaaucacauacacauuggggacuuuguuuuugccauuuauacuugagaccagcuuugcagugugauucuuucaaaggauugguuucaagaauauagaggcuggaaauuacgguacagaaauggagcuagaaaaugaguuuguguuacacagagaugucaucuucuccuagaguuaucuuguuucuuauuccuagucuuuccagucaaauccguggauguagcuaaguauaucuaaaacucauuuuuccacuauuguugguauuugaaguugaacagcuguacauugcugugggggagccaaaggauuggaacccucauuaauuuaauugcuuggaaaugcagcuaaaauucuucuuuggcauuuuguuuugaaaguuuaggcauuuuacucuacuuuagauuuuaguuugcuugcaguuuuuuguguagauuugaaaauuguauaccaauguguuuucuguaggcuuaaaauacacugcacuuuguuuagaaaaaaaucuggagaugaaaauauguauuauaaagaagagaugucaagaauuugagauaacuccuugagaaaguuggcuuuaugucaucagcaaaggacacuuaacgucaagcauacacugugguuuuuuuguuuuuuuguuuuuuuuuuucaaauuagaaaguuuaaugaccguuacagauggacagugucuuuuuauuuauaggaguuuuucaggaugucagaguagauagguaggaaaauuguuauuagaacauucgcuucuaccuugaaaaggauguuaauguggucauguucuuagcaccacagugucugggcaucugggaaacuccgagacuuuuuuaaagugucaugaugugaucacaccugcaguuuggggcaucgaauccagggccuugcaugucuucuguaagagcucucaucgcugaccuguaucccccgcaagagcaaugacuuuugcuaacaguauuucuuuucuguuguaaaguggacagaugauacacuuggucgcaaagguaaauuauucaaaauccacagugaaaaccucaccacacuuucccauuuaaacuauuuccauaucucagagguuucugacaugcaaacuugaacccuugaaagaagaguuuucuuaaaaauuauaaaaaaucacgaguuacaauuugcacaauauuuuuuguugaacuuuauaccuuguuuacaauaaagacuuuucuuug

SEQ ID NO: 66 - RNA, 526 nt, Homo sapiens
  misc_feature (7)..(7): n is a, c, g, or u
uugucanuugcacgacagaaacugcaggaagaugagaugcgccgggcugcggaggagcgcaggaggguaaaggcugaagaguuagcugccagacaaaggguucuagaaaaaauugaaagggacaaagcagagagagccaagaaguauggugguaguguggguucucggucauccccaccagcaacagacccagguccuguuccuucuucucccagccaggagcccccuacuaagcgggaguaugaccagugucguauacagguuaggcugccugaugggacuucacugacccagacuuuccgggcccgggaacagcuggcagcugugaggcucuacguggagcuucaccguggggaggagccuggacaggaccaggacccugugcaguugcucaguggcuuccccagacgggcuuucucagaggcugauauggaacggccucugcaggaacugggacucgugccuucugcuguccucauuguggccaagaagugucccagcugaggguucuccaucccaccaucuc

SEQ ID NO: 67 - RNA, 425 nt, Homo sapiens
uuuuuuuuuuuuuuuuucacaaauaaguaauauaacuuuauuaaaaugaaaagacaauauucaaaauaaugcaacaaaaugaauaaauccuuuguccaauacuguacacacagugcggagaucagugcauuuuucuaaagcauguuuuaaccuucauuuaguucauacuaaaguaagcuuuaaauagcucaaauaaugucauucagcaguuuaaacugaacagcuuguugggacauggcagcagugucccugcuagcaagcaccuucucuuuguguuuaucugcacaagauaaacaaucagaggauguaaaaacugaacacaaacugcgugucucacugaaucucagggcagugaagcagccagcgugaguuuucaaagcaggaagaugcugaagugaccucuggcauuaagacguucugugcua

SEQ ID NO: 68 - RNA, 2282 nt, Homo sapiens
uucauuggaaagcacauugcucuucucaguaauuucuuuaguaucuucaugaauuuuuuccuuuugcgucguuauuucagcaauucuaucugcagaucauaaagguaguauugacagaugugauucuuuuucuuaaacauuucauuuccaggguaaggaacucaauggcuauguuuuucucucccucuagugcauccuucuccuuuucuaccauuuucacucuauuuaacuucaucauguucagucuggccuuuggguuucaucauagcaaucuguucaacuucacccugcaagauuaaaaaucgauuauggucuaagucaaugccauggcuucuaaggagauuuccaacaucuuuaaacgucuucuucuucccacuuaugugguagacagaagugcuaucucuguaggcgguucuggauacauagaaguugcuguuaggaaggacuucguaaucaucuccuuccuuaucaauuaucuuuugaaaaugaacuucuacaguacaacucugaauauccuuguguucaucagaauuauguaucaguaccgauagcuuuuuagaccuuauuuuuugugcucgauagccaaacacaaaaagcauggaaucaauaacauuggauuuuccacugccauuugguccaauaauacaggaaaagcgcuuauggaaaggucccacaaguuucucuccagcauaggacuugaaguuuugguuuacaauaugaguuaucaugagacgaggagcuccagcuucacuggccauggcuggagguggggguggagggauacuauucaaaaucuccucuaaacuucuguuauccagcuccucaccuggaggcuuugcgggugcagcgcuccccucaccuacuucgccuacugcaacucccaccaccuccucucgauacaagaccgagcucugucggaccuacucagaaagcgggcguugucgcuacggggccaagugccaguuugcucacggccugggugaacuucgccaagccaaucgccaccccaaguacaaaacggaacucugccacaaguucuaccuccagggccgcugccccuauggcucucgaugccacuucauccacaaccccaccgaggaccuagcucucccuggccagccccaugugcugcgacaaagcaucagcuucuccggcuugccucaggccgcagaagcucgccgccaccuccaggcuuuucuggcccuucccuguccucuuguuccuuuucgccuuccagcuccccaccgcccccuggggaucuuccacuuuccccuucugccuucucugcugccccugggaccccugugacucgaagagacccuaaccaggccuguugccccuccugccgaaggucuacuacccccagcaccaucugggggcccuuggguggccuggcucggagcccaucugcccacucucugggauccgauccugaugacuacgccagcagcggcagcagccugggggggucagacucaccugucuuugaggcagggguguuugggccuccccagaccccugcacccccaaggcgucuccccaucuucaaucguaucucugucucugagugacaagugccuaccuacccaguauggaucagcuagaucucaaagagagggcagggacugcucauugcuguggggaccuggggcacuccucuaaguuaauaagucccaucuucuggacauuccaagaugcaauaacccauuucccuggugcugggcuggggcaggucccuaguuugcaaauucaguguuuggguggauccguuccuaggguaccuaagauguuugagggagacaguugacaguuggucuuccaggccccaagucuucuguuguuuuugagauaggagcuuauuaugguaccccaggcuggcuuugaacucaauauaauccugccuuagccuuuuccaaguucugggguuacagguaugcaccagccccucugcaacucuggucuccuggaaucuuaagugcugugaagagccggcucccacaauacuauccuaauuuuuacuagacccugaaguucaguguccgguggucgaagccucuccugagaauccuggugcucaaauuucccuccuaaagcaaauagccaaagccauugccaaaucccuucucccccaaccagugggcccuuuauuuaugacgacuuuauuuauuguauuaagauuuuauaguauuuauauauauugggucgucuacuccguuuuucuuuuuguaauguuaaaacugauacuguauuaaguauaugcuauaauauauuaauauauugcu

SEQ ID NO: 69 - RNA, 364 nt, Homo sapiens
cggacgcugcagaccugaccgacgugcugugcgaguucgacgcggugcuggccgacuucgcgucgcccuuccacgagcgcacuuccacuaugaggagcaccuagagcgcaugaagcggcgcagcagcgccagcgucagcgacagcagcggcuucagcgacucggagagugcagacucaguguacagggacagcuucaccuucagugaugagaagcugaauucuccaaccaacuccucuccagcucuccugcccuccgcugucacuccucggaaagccaaauuaggugacacuaaagagcucgaagacuucauugccgaucuggacaggaccuuagcauguaugugaagcaaggaguuugggguc

SEQ ID NO: 70 - RNA, 847 nt, Homo sapiens
ccgggccgaggagaagucugcaaaacaagaggcuggggauugccuuagcgagaaaucaguucucuuaggagguuagggaaggaagucuuucucuggaggucugagggaagcgcucgugucagaugccggguugucauggguaagggugaccccaucaagccgcugggcaaaauguccucuuacgccuuuuuugugcagaccugccgggaggagcacaagaagaagcaucccaauucgucggucaacuucgccgagaucuccaagaaaugcuccaagagauggaagaccaugucugcaaaggaaaacucgaaguuugaagauuuggccaagagcgacaaagcuuguuauuacagggagaugaagaacuauguuucucccaaaggugauaagaaaggaaagaaaaaagauccaaaugcuccgaagagaccaccgucugccuucugccuguuuugcucugaaaaucgcccaaagaucaaaauugaauacccgggccugucuauuggagauacugcgaagaaacugggugagauguggucugagcagucugccaaagagaaacaaccguaugagcagaaagcagcuaaacuaaaggagaaguaugaaaaggauuuugcugcauaccgugucaagggcaaaagugaagcaggaaagaaggguccugguaggccagcaggcucaaagaagaaugacucagaagaugaggaagaagaagaggaggaagaugaagagggggaagaagaggaugaagaauaaguggcuauccuaaaguguggaguauaugugcucaggcaguuauuuugcuaagaauguaaauucaagcgcagcucaacauuagcuccaguaggaa

SEQ ID NO: 71 - RNA, 779 nt, Homo sapiens
aucacgcuccuagaacucuucaaaccgaucucucgucgaucuucaaccgccgccuccacucgccauggaccccaacugcuccugugccuccgguaagggggacugcugacgggauuucugggagagcuagacaggcuuuuuggccccuccuuuaguaauuacuuuaaggguacgaccggcuaccccuuccgaaugaauucugaagcacuccugcuccuuuaaacuaguccuugagauaguggcucgccuacccgggugauuugccucaccuuccuaggagaacagcguucagguacucccgggucccacucaaccgcgcucacugacugccuucuacuuuuagauggauccugcuccugcgcuggcgccugcaaaugcaaacaaugcaaauguacuuccugcaagaaaaguaaguuggaucuucucugccauuuccccgucacucuccuggggucccuagcccgccgcgccgcgccuucccucccgggagcguucagguggugugccucugacaagguuucucgcucacguucaacucuucucuccccacaggcugcugcuccugcugccccgugggcugugcgaagugcucccagggcugcaucugcaaagaggcuuccgacaagugcagcugcugugccugaaggggggcggagggguccccacaucuguguaaauagaccauguagaagccuagccuuuuuuguacaacccugacucguucuccauaacuuuuucuauaaagcauguaacugacaauaaaagccguugacuugauu

SEQ ID NO: 72 - RNA, 2275 nt, Homo sapiens
gcucugaguuuguggaagauuacaugcgauaucccgcgcgaccccgcaucccuuugccggccgggacagccuuugcuacagccugugaaacauugcguccccgagccccacgccugagggcgacaugaacccgcuggcuucgcgagcaguccggacccacgaucgcuuuuggcaaccagaaccggcgcuucagcccccggggugacgugcagcccgccgcccagacacauggccccgagcccaagaccccagcauguccugcacuggagggacgcccacaacuucuaucuccuguccccacugaugggcuugcucagucgggccuggagccgccugaggggcccagaagucccagaggcauggcuggcaaaaacaguaacaggagcagaucagauagaagcugcggcucugcugacaccuaccccugucucugguaaccuccucccucauggggagacugaagaaaguggaucuccugaacagagucaagcagcccagaggcucugccuuguggaagcugaaaguuccccuccugaaacuuggggacuuucaaauguugaugaguacaaugcaaagccaggacaagaugaccuuagagagaaggaaauggaacgcacagcuggcaaggccacacuacagcccgcuggccugcaaggggcugauaagaggcuuggggaggugguggcuagagaagagggaguggcugagcccgcuuaucccacaucacagcuggagggugguccagcugagaaugaagaggauggagaaacagugaagacuuaccaagcuucugcugcuuccauagcuccgggauacaaacccagcaccccugugccuuucuugggggaggcagaacaucaagccacggaagaaaaaggaacagaaaacaaggcugaccccuccaacucuccuucuucaggcucccacuccagagccugggaguacuacucuagagagaagccuaagcaggagggagaagccaagguagaggcacacagggcagggcagggucacccuugucggaaugcugaggcugaggaaggaggaccugagacaacuuuugucuguacuggaaaugccuuccugaaggccuggguguaucgcccaggagaggacacagaggaagaagacaacagcgauucggauucagcugaggaagacacagcucagaccggugccaccccccauacaagugccuuccugaaggccuggguguaucgcccaggagaggacacagaggaagaagacagcgauucggauucagcugaggaagacacagcucagaccggugccaccccccauacaagugccuuccugaaggccuggguguaucgcccaggagaggacacagaggaagaaaacagcgauuuggauucagcugaggaagacacagcucagaccggugccaccccccauacaagugccuuccugaaggccuggguguaucgcccaggagaggacacagaggaagaaaacagcgauuuggauucagcugaggaagacacagcucagaccggugccaccccacauacaagucccuuccugaaggccuggguguaucgcccaggagaggacacagaagaugacacagaagaggaagaggacagugagaauguggccccaggugacucagaaacagcugacucaagccagagucccugccuucagccccagcguugucuaccaggagagaagaccaagggacguggggaagagcccccucucuuccagguggccuucuauuuacccggagagaagccagaaucaccuugggcugcaccuaagcugccccuucgacugcagaggcggcucagauuguucaaagcccccacccgggaucaggaccccgagauuccucuaaaagcucggaagguacacuucgcugagaaagucacaguccauuuccuugcugucugggcaggaccagcccaagcugcccgucgaggucccugggagcaguuugcacgagaucgaagccgcuuugcucgacgcauugcccaggcagaggagaagcugggucccuaccuuaccccugauuccagggccagagcaugggcacgccuuagaaacccaucucuuccacaguccgagccucgcucuuccucugaggccacucccuugacccaagaugugaccacacccucuccccuucccagugaaaccccuucgcccagccuguacuugggagggaggcggggcuaagccugaguaguuuccuauuauuuauuuauuuauuuauuugaauaagaaauaaagccuuuuaauuuguagugau

SEQ ID NO: 73 - RNA, 355 nt, Homo sapiens
uuuuuuuuuuuuuuuuuaaucaucgagaaguauuuauugagcaccagcuuuggggucgggugugaggacucgggacaaugcagggugcugucccuucucgugagacgcuuacaaucugaguggagacagggagggagccacaauacauguucuuggggugcgggcuaaggguagacaguccagaccaggauguuacagaaacagggauguuuggggcuggagucagacccacuaagugcuuugacacccacgguauucaacacugagaaaggaucagccauugcucaguguccugugagcucccuuagcccccaagacaccaucuuggccuggcuccuuguacaacugcuacuaa

SEQ ID NO: 74 - RNA, 289 nt, Homo sapiens
cccaaaacccauucagcaaaguucccaaccucgacgggcuagcaguauuuaaccagugauggguucacuguuguauuuggugaauacuguauuuuguuucaguucuuucucccagauaauuugaaaacguuccaggagaaggcagcuuccuauaugcagcgugugcuuucuuauucuuuuuuuuaauauaugacaguuauuugagaacccauuucuacuuugaauucauuuucguugaaagugauguuucuucaccuaccauuuuccuauuaaaguucuguauucaaau

SEQ ID NO: 75 - RNA, 2018 nt, Homo sapiens
agaccgugagcgagagcgccccagagaagcgccugcaaucucugcgccuccuccgccagcaccucgagagaaggacacccgccgccucggcccucgccucaccgcacuccgggcgcauuugaucccgcugcucgccggcuuguugguucugugucgccgcgcucgccccgguuccuccugcgcgccacaaugagcuccagcaccuucaggacgcucgcugucgccgucacccuucuccacuugaccagacuggcgcucuccaccugccccgccgccugccacugcccucuggaggcacccaagugcgccccgggagucggguugguccgggacggcugcggcugcuguaaggucugcgcuaaacaacucaacgaggacugcagcaaaacucagcccugcgaccacaccaagggguuggaaugcaauuucggcgccagcuccaccgcucugaaagggaucugcagagcucagucagaaggcagacccugugaauauaacuccagaaucuaccaaaacggggaaagcuuccagcccaacuguaaacaccagugcacauguauugauggcgccgugggcugcauuccucuguguccccaagaacugucucuccccaaucugggcugucccaacccccggcuggugaaagucagcgggcagugcugugaagaguggguuugugaugaagacagcauuaaggacucccuggacgaccaggaugaccuccucggacucgaugccucggagguggaguuaacgagaaacaaugaguuaaucgcaauuggaaaaggcagcucacugaagaggcuuccugucuuuggcaccgaaccgcgaguucuuuucaacccucugcacgcccauggccagaaaugcaucguucagaccacgucuuggucccagugcuccaagagcugcggaacuggcaucuccacacgaguuaccaaugacaacccagagugccgccuggugaaagagacccggaucugugaagugcguccuuguggacaaccaguguacagcagccuaaaaaagggcaagaaaugcagcaagaccaagaaauccccagaaccagucagauuuacuuaugcaggaugcuccagugucaagaaauaccggcccaaauacugcggcuccugcguagauggccggugcugcacaccucugcagaccagaacugugaagaugcgguuccgaugcgaagauggagagauguuuuccaagaaugucaugaugauccaguccugcaaauguaacuacaacugcccgcaucccaacgaggcaucguuccgacuguacagccuauucaaugacauccacaaguucagggacuaagugccuccaggguuccuagugugggcuggacagaggagaagcgcaagcaucauggagacgugggugggcggaggaugaauggugccuugcucauucuugaguagcauuaggguauuucaaaacugccaaggggcugauguggacggacagcagcgcagccgcaguuggagaaugccaaggggcugauguggacggacagcagcgcagccgcaguuggagaagacuucgcuucauaguacuggagcgggcauuauugcuccauauuggagcauguuuacggaugacguucuguuuucuguuuguaaauuauuugcuaaguguauuuuuuugcuccagacccccccccccuuucuugguucuacaauuguaauagagacaaaauaagauuaguugggccaagugaaagcccugcuuguccuuugacagaaguaaaugaaagcgccucucauuccuucccgagcggagggggacacucugugaguguccuuggggcagcuaccugcacucuaaaacugcaaacagaaaccagguguuuuaagauugaauguuuuuuuauuuaucaaaguguagcuuuuggggagggaggggaaauguaauacuggaauaauuuguaaaugauuuuaauuuuauaucagugaagagaauuuauuuauaaaauuaaucauuuaauaaagaaauauuuaccuaaa

SEQ ID NO: 76 - RNA, 358 nt, Homo sapiens
ccaauaccacagccgugaccacagccaagaccacagccaaaagccuggccauccgcacucucggcagcccccuggcagugcccuccauauccugcuuguuuuucucauuaguaaacuccucuucuaaagaaaacuggggaagcagaucuccaaccuccaggucauccucccgagcucauuucaggccagugcuuaaacauacccgaaugaagguuuuauguccucaguccgcagcuccaccaccuuggaccacagaccugcaacacuagugcacuugagggauacaaaugcuugccuggaucuuucagggcacaaauuccgcuucuuguaaauacuuaguccauccauccugcgugua

SEQ ID NO: 77 - RNA, 870 nt, Homo sapiens
auggagaacgaguucacauacgaagauuaugagaccacugccaaguggcuucugcaacacacugaauaucgaccucaaguggcagugaucugugguuccggcuuaggagggcugacugcucacuuaaaggaggcucagaucuuugacuacaaugagauacccaacuuuccccaaagcacagugcaaggucacgcaggccgacugguguuuggauugcugaauggcagaugcugugugaugaugcaaggccgguuccauauguaugaaggauacucacugucaaaggugacauucccagugagaguuuuccaucuucuggguguggaaacuuugguggucaccaaugcugcuggaggacucaaccccaauuuugaaguuggagauauuaugcugauccgugaucacaucaaccuaccugguuucuguggccagaacccucuccggggccccaacgaugaaagguuuggaguucguuuuccugccaugucugaugcuuaugaccgggauaugaggcagaaggcuuucagugccuggaaacaaaugggggagcaacgaaagcuacaagaaggcaccuacgugauguuggcaggccccaacuuugagacuguggcagagagucgucugcuaaagaugcugggggcagaugcuguuggcaugagcacagucccagaaguuaucgucgcaaggcacugugggcuccgugucuuugguuucucacucauuacgaacaagguugucauggauuaugagaacuuggagaaggccaaucacauggaaguucuggaugccgggaaagcagcugcacagacauuggaaagguuugucuccauucuuauggagagcauuccacucccggaucguggcagcuga

SEQ ID NO: 78 - RNA, 4928 nt, Homo sapiens
uuccaggacagcuggggcuccacgagagaaacccugccucccccccaaaaauggcccaaaguucacugacaaacucacauuugucugauauuuagcuauguaacagcacuuacgguagcaauagaauuugauucucacucaucacaaugaaaauggcuggcgcucucucucucccucucuccccauuucaaaucugcaagcacaccccuuagagauggagagaauuugauccauuggagaaucgagcuaaaaauaccaccauggaauugugggaaggauuaaaugcaauaaugcacaaaaggcacauagcagaaugugcccuaaaugucagccauuguuaugguauuauguaaucuacaaaguauguuugcuuacuccgugugaaagacuuucagucuaucaaacauaauacaugugaaaucaaaccuugaaaauuaauuuuuuucccaacagucaagacauuugccagcugcagagauuagcauuucaugaaucuuagucuugucugauuuuuuuaaugggaaggaacaacuauccucaacuauccuuuuuuuuuuucuguaguuuuaaaaugaacuccacaaaacauguuuuuaauauagggaauuauaugaaauuguggggugggcagcgagguuaaaggcagaaauagcccaaugguggcacauucacugacacagccuaaaagauuagcaaauuacccagccaacacauacaauuaauacaauuaauauuuuuauaguuaaaacagaguuacuaaagaaauuguuugaaaagaaaauuaugaagacuggaaagacggcucagugcuuaagagcuuuggcuagucuuccagagaaccagggucauccagcacucacaaggcagcuugugagcugauacuaucuguauauucaguccuagggaaucugaugcuuuguccugaccuccaaaacaggcacaaauguggugcacaggcaaauguagagauaagacucccaugcacagaacauaaauaacguaguuuaauuuuuuaaauuguaaaacugaaaaugguugcacuugcauuuuuauuuucagcacauccccagauauccgccauauaacaagaaaaugaugccacacucccaagaauuaagaauuacaccucccaacccuacccaaauguguauacucuaggucuaaagaaaugcaaaggaugaaguuacugccuugugcgguucucaaggagggaggaugccaaaaaaauauuuuuucacaaagugugcugagaaacucuguagcuguuggagucaucuccugugcucuugccaaauaacugaaaggggauacacuggaugucugugaauggggugucacuuaugagugcuagaagcggguaccuggauguggacacggugucugagugguccgcacuccaugucuccacaggagcgcuuauguguguuucuuuccuccugcuucuggguguuccuggguuuguuuacagccaccucucuguuggaccaggagacagcugucgucuccagaaugagcgggcacgggugugucucgguggcuguggcugugguucggcauaagucugagcauguccuggucgucagggugcguuugugcugugugugcguguccgggugagcuugcucuuucuguuccuaaaagaaaaugcacccugcgcuaccggcguccagagacucucagcccgcagaggugaccugaacggacagguagcaccuccagacagcgccugguuggcggguugcacagcagccccagauuucucucucuggugccccagcuaggguagcuggaagggagcgguggccuggccuccggggagccgcugggccccgccgggcuaacccaggaggaggccggcuaggcugggaggguuagcccuuggugcccuacgccugcccgggccagucgcggccgccggccauuggcccaaagaauuguugcacgucacuggcaauuccccuagaagucugugcacauaacgggcagggcgcacugcaaggcugcuucucccgcauuuaggcugcggcugcaggcaccgcgagcccggagcacccacgagcuuagugugcaggacgcaccccagcacagccaccuacggccgcugaaugaagcuuccaggaguccgcccccggccgucgccccgucggaggugcacccgcugagagcgccuggaccgaaaggccggugcgcucaccugcuaaccugccagccauggggccacacgggaacgacagcgacuucuugcuggcacccaacggaagccgagcgccacaccacgacgucacucaggaacgggacgaagcguggguugugggcauggccauccucaugucgguuaucguccuggccaucguguuuggcaacgugcuggucaucacagccauugccaaguucgagcgacuacaaaccgucaccaacuacuucauaaucuccuuggcgugugcugaucuagucaugggccuagcgguggugccguuuggggccagucacaccucuaugaaaauguggaauuuuggcaacuucuggugcgaguucuggacuuccauugauguguugugcgucacagccagcaucgagacccugugcgugauugcaguggaucgcuauguugcuaucacaucgcccuucaaguaccagagccugcugaccaagaauaaggcccgaguggucauccugaugguauggauuguaucuggccuuaccuccuuuuugccuauccagaugcacugguaccgugccacccacaagaaagcuaucgauuguuacaccgaggagacuugcugugacuucuucacgaaccaggccuacgccaucgcguccucgauugugucuuucuacgugccccugguggugauggucuuugucuauucccgggucuuccagguggccaaaaggcagcugcagaagauagacaaaucugaaggaagauuccacgcccaaaaccucagccagguggagcaggaugggcggacgggccacggacuccgaagguccuccaaguucugcuugaaagagcacaaagcccucaagacuuuaggcaucaucaugggcacauucacccucugcuggcugcccuucuucauugucaauaucgugcacguuaucagggacaaccucaucccuaaggaaguuuacauucuccuuaacugguugggcuacgucaacucugccuucaauccucuuaucuacugucggaguccagauuucaggauugccuuucaagagcuucugugccuucgcaggucuuccuucgaaaccuaugggaacggcuacucuagcaauagcaacggcagaacggacuacacaggggagccaaacacuugucagcuggggcaggagagagaacaggaacugcugugugaggaucccccaggcauggaaggcuuugugaacugucaagguacugugccuagccuuagcguugacucccaaggaaggaacuguaguacaaaugacucgccacuguaauacaggcuuucuacucucuaagaccccuccuugacaggacacuaaccagacuauuuaacuugaguguaauaacuuuagaauaaaauuguauagagauuugcagaagggggggcacauccuucucgccuuuuuuuaauuuuuauuuuauuuuuuagcugcaaacaagagagagaacuguauuugagugcuuauuguucuuguauaguucaguuccucuuguauggaacuuaaagguuucugucugaagaguguugguucugaggacugagucugucugucugucugucugucugucugucuggaugauguuuucauguaucuaccucacuggucaaguauuaagaaugauauauauugcugcuggaaauccauaucuaaaggagagaguuuucuuccuguacccuuggacuugaaauauccugugucuuggaccuuucugcugugacaaugggcccuuucucucucacuccacuuauuuacucaaauggauucgaggcagggauuugagggacaacacuaguuguuuuguuuuuguuuuuguuuuuuuguuuguuugguucguuuuugguuuguuguuguuuuuugggguuuguuuuuguuuuuguuuuuuuggguuuuuuuuuuuugcugagaaaagucuaaaguuuacaguaaauaaauuguuuaaccaugacuucauugcacccguuucuucaaaaccucuugacucuggaguguccuugucucucccacuggaaaccacagguaaacuaugugucgugaccgaugaguggcuuaauguguaagaguaccagaauggcaugcuugcaugcaccgugccuagcccuuccgugugugucuucagagcuccagaugcaaaccugugccuucccuaacuucacucgugucccaaagcaguccugccuguucacagcauaacccaguauguccuacaguugcucuucugugcugucacuccagaaacccugacucacggaaacagaguuauggacauauguuuuuguccccauaugcucugacaccaccuucagccuuacuugcuuaauaacuguguauauuuacaucacugcgucucuuacaguagugccuuuguacugcaucagggcuugguguguucaggaugaggaagauguucuguguaauagcuguucaagcaucuagaaauucugagggaaaucaaaggccucggucagagagagagagagagagcaaagcuuuaaaaaacauagcuggugaaugcuucacgcccuucagccucuccucgcuccgucugcugucccgugucuucuguucccaauucucugcacuucuguguaaaccaggcuucccaugucuggcauuccgugcauuauaugauauuuggcggcacgucuguaccaguaaauucugguagcacccccuaguuacaauaauugcagacacucagcgcguacgacccccuaguuacauaugcagacacu

SEQ ID NO: 79 - RNA, 374 nt, Homo sapiens
uuuuuuuuuuuuuuuuuaagcguccaggcuguacuuuauuuuacacaagugguggccccagaaccacagggacaugaccuggagaguaggcacagugccugaggcugcaagagccaaauacagggauucaugccuucuccuugguccccaugaccaaauuaaaaaaaaaaaaaacaacaaaucacacagcacacaucgccacacccauccccuccuuccuuucagcaacagccaauucagcuuucuagccaaagacaguggcuacaacugaauuuacagagaaccaugcagccaagaaaccagagccacggaggggagaggcuugcguugacuucccacaugugcugucccauagcagcugagugaccccacca

SEQ ID NO: 80 - RNA, 1285 nt, Homo sapiens
agaaagauaagggccagcaaggaaagaaugaggaugugggcgccgaggacccguccaagaagaagcggcaacgccggcagaggacucauuucacuagccagcagcugcaggagcuggaagccacuuuccagagaaaccgcuacccagacauguccacucgcgaagaaaucgccguguggaccaaccuuacggaagcccgaguccggguuugguucaagaaucgccgggccaaauggagaaagcgggaacgcaaccagcaggccgagcugugcaagaauggcuuugggccgcaguucaacgggcucaugcagcccuacgaugacauguaccccggcuauucguacaacaauugggcugccaagggccucacgucagcgucucuguccaccaagagcuuccccuucuucaacuccaugaacgucaauccccuguccucucagaguauguuuuccccgcccaacuccaucucaucuaugaguaugucguccagcauggugcccuccgcggugaccggcgucccgggcuccagccucaauagccugaauaacuugaacaaccugagcagcccgucgcugaauuccgcggugcccacgcccgccuguccuuacgcgccgccgacuccuccguacguuuauagggacacauguaacucgagccuggccagccugagacugaaagcaaagcagcacuccagcuucggcuacgccagcgugcagaacccggccuccaaccugagugcuugccaguaugcagucgaccggccggugugaaccgcgcccagggcgcggggauccgaggacugucggagugggcaacucugccccagaaagacugagaauugugcuagaaguucgugcgcacuaugggaaggaagaggggggaaaaaagaucagaggaaaagaaaccacugaauucaaagagagagcgccuuugauuucaaaggaauguccccaagugucuacgucuuucgcuaagaguauucccaacaguuggaggacgcguacgcccacaaauguuugacuggauaugacauuuuaacauuacuauaagcuuguuauuuuuuaaguuuagcauuguuaacauuaaaaugacugaaaggauguauauauaucgaaaugucaaauuaauuuuauaaaagcaguuguuaguacuaucacuacaguguuuuuaaaggcuaggcuuuaaaauaaagcauguuauacagaaucaguuaggauuuuucgcuugcgagcaaaggaauguauauacuaaaugccacacuguauguuucuaacauauuauuauu

SEQ ID NO: 81 - RNA, 801 nt, Homo sapiens
cugagaggccaggugggcggcgaaaucaacguggagauggaugccgcucccgguguggaccugagccgcauccugucagagaugcgugaucaguacgagaagauggcggagaagaaccgcaaggaugccgaagacugguucuucagcaagaccgaggagcugaaccgcgagguggccaccaacagcgagcuggugcagagcggcaagagcgagaucuccgagcucaggcgcaccaugcaggcccuggagauugagcugcagucccagcucagcaugaaagcaucucuggagggcagccuggcagagacagagaaccgcuacugcgugcagcugucucagauccaggggcugaucggcaguguggaggagcagcuggcucagcugcgcugcgagauggagcagcagaaccaggaguacaagauccugcuggaugugaagacaaggcuggagcaggagaucgccaccuaccgccgucugcuggagggagaggaugcccaccugacucaguacaagccaaaagaaccugugaccacccgccaggugcgcaccauuguggaagaaguucaggauggcaaggucaucucaucccgggaacaggugcaccagaccacccguuaaggacucagcuccuuccgcccaguuccccgaggcugcagagaggcagcuucccucuccgcuccggcaucacccuccugcuacagccucuccccagcauuccuaugcuugagaccauuaaagcuugcugaccugaagugaacuguggccuuuguucugaacacugaaauaaaugaccauggugac

SEQ ID NO: 82 - RNA, 216 nt, Homo sapiens
ccccaggggugaaaugaggauucccccacccugcggaacagugaaauguguauaauuaagaggagggcgacgacccuugccgcgggacccgggacucgagcccgggacuucgcagcuacagcaaaucuauuuuuaauauugugcugagcaagacagaucgcuugcauauuuuuaaaaauuuuuacuacagagacauuccaauaaauucguuaagcc

SEQ ID NO: 83 - RNA, 2901 nt, Homo sapiens
cugacagucgucucugucccuucuucgccucggagcugcuaacuggucucgaaccucucagcacuucagcuucuagcggcgaugcaugugaucaagcgagauggccgccaagagcgaguuauguuugacaaaauuacaucacgaauccagaaacucuguuauggacucaacauggacuuuguugauccugcucagaucaccaugaaaguaauccaaggccuauauaguggggucaccacaguggaacuggacacccuggcugcugagacagccgcgaccuugaccacgaagcacccugacuaugccauccuggcagcaaggauagccgucucuaacuugcacaaagaaacaaagaaaguguucagugaugugauggaggaucucuacaacuacauaaauccgcacaacggcagacacucucccaugguggccagcucaacacucgacauuguuauggccaauaaggaucgccugaauucugccauuaucuaugaccgagauuucucuuauaacuacuuuggcuuuaagacacuggaacggucauauuuguugaagaucaaugguaaaguggcugaaagaccacagcauauguugaugaggguuucuguggggauucacaaagaagauauugaugcugcaauugaaaccuacaaccuacuuucugagaagugguucacucaugccccuccuacucucuucaaugcugggaccaaccgcccacagcugucuagcuguuuccucuugaguaugaaagaugacagcauugaaggaauuuaugauacucugaagcagugugccuugauuucuaaguccgcugggggaauugguguugcugugaguuguauucgggccacugguagcuacaucgcugggacuaauggcaauucuaauggccuugugccaaugcugagaguauauaacaacacagcucgcuauguggaucaagguggaaacaagcgcccaggcgcguuugcuauuuaccuggagccuuggcacuuagacaucuuugaguuccuugacuugaagaagaacacaggcaaggaagaacagcgagcacgcgaucucuucuuugcacuuuggaucccagaucucuucaugaagcgaguggagacuaaccaggacuggucauugaugugucccaaugaguguccuggucuggacgaggucuggggagaggaguuugagaaguuauaugaaaguuacgagaagcagggucguguccgaaaaguuguaaaagcucagcagcuuugguaugccaucauugagucccagacggagaccgguaccccauacaugcucuacaaagauuccuguaaccggaagagcaaccagcagaaccugggaaccaucaaaugcagcaaccuguguacagaaauaguagaguacaccaguaaagaugagguugcaguuuguaacuuggcuucucuggcucugaauauguaugucacaccggaacauacguaugacuuugagaaacuggcagaagucacuaaagucauuguccgaaaucugaauaaaauaauugauauaaacuacuacccuauuccagaggcacacuuaucaaacaaacgccaucggcccauuggaauugggguacaagguuuagcagaugcuuucauccugaugagauaccccuuugagagcccagaagcccaguuauuaaauaagcagaucuuugaaaccauuuacuauggagcccuggaagccagcugugaacuagccaaggaguauggccccuaugaaacguaugagggaucuccagucagcaaggguauucuucaguaugacauguggaauguugcuccuacagaccugugggacuggaagccucucaaggagaagauugcaaaguaugguauaaggaacaguuuacuuauugccccaaugccuacugcuucaacugcccagauucuggggaauaaugaguccauugagccuuauaccaguaacaucuacacucgaagagucuugucaggggaauuucagauugugaauccucacuuacugaaagaucuuacugagcggggcuuguggaaugagagaugaaaaaucagauuauugcaugcaauggcuccauucagagcauaccagaaauuccugaugaccugaagcaacucuauaagaccgugugggaaaucucucagaagacuguucucaagauggcagccgagagaggugcuuucaucgaucagagccagucuuuaaacauccauauugcugagcccaacuauggcaaacucacuaguaugcacuucuacgguuggaagcaggguuuaaagacuggaauguauuacuuaaggacgaggccugccgcuaauccaauccaguucacucugaacaaggaaaaacugaaagauaaggaaaaggcacugaaggaggaggaggagaaggagaggaacacagcagccauggugugcucuuuggagaacagagaggagugccugauguguggauccugagaaaagcggggccugggagacgcagcgggcucuccugcccgagaggcagacgauuugagcauagauaggauaguggguuugcuugguuaucagcagcucugcuuggacgugccugccaggacagggagccacgacuuacaguacuguuucuacacaguguaaauaucauuuuuaacaaacagaaaaccaaagccagcuuugauauuaggaaucaagguagaggcuuugggaauacuaaagagccuuccugcaaauagugaggagacuuaggaagucucgucucuccagcuuucccugccuggccauucucaguuugggcaaagagauuuaguuugauuugacugauugccuagaaguaaaaucaagcaauuacucaucagcuaaagaccuuugucuagacaaacuucuauaagucauuuugaaauaaacauuucuaagugau

SEQ ID NO: 84 - RNA, 8752 nt, Homo sapiens
uugccucagacgcuagcuguagcuggcaggcgguuguacgugcuccagagucgucgguacccgcuacugcagucgcuuucguguggcuuccgcugagcucuuccgagcugcucgcucuccacacgcgccgccgccguaauccgccaccauggugaagcucgcaaagguaagaggccuuggcgcgccgacgcggacgacuaggccccugcuuucggagggacgcgcgcgcgcccgcccguccgucgcggaggggaggagggcuugcgcgcaaucccgggcgcguucgagggcgccaugcugggggggaaagucucgcgcgacuagcgggaggucucgcggugcuugcccucugacuuagggggaugagaagagcggaggcagguuuccgggagggcgauaucgaggguucggauguagcgggcgggaggggacggugugaggagagaucggaggagcugagagcggauaggggcacggcgugggaagagagggccaaccuuaggcggcgagcggucccggggccccgccuccccgcgcacgugcucuggugcgcgcccgccacgugcucugcggagccccgcacgugucgcgcgacccggggcagugggggagugucuguaguaccccggaaagggggacggcagcguggggauggauggguggcccggcgaucugcugucucugccggugaccgggauggacacgugguggaccccugagguggcggcguggugacuccacgugguggggcuggaagcgagagaaagugggaagcaguuggguuacguggugcugcuuuaagaggugauuucgagauacccccuuccccagcaaauaacuuaaagggaucccuuuaacuggguuuuuuuuuuuuuuuuuuuuuuuuuuuuuguggaagaugccagaaaauagauggccaggauuaggagacuuuauaaccuguggcuguuucuugguguagaguucugucugcucaguuaucugugagaaggaaaaaaaaauuaugcgcgguucgcagaaaaaacugccaggagaaugccaugccuggccaagaagaagucuuuaugcuuguguccuuuaguaagaaaaaggugguggccaaaggcaaagugacugaaaaugcgugcaauuuuugugugcguuuguaggcuggcaaaacccacggugaggccaagaaaauggcuccuccuccaaaggagguggaagaggauagugaagaugaagaaaugucagaagaugaagaugacagcaguggagaagaggagguaagaagcuauuugcagcgaauuaaaccgguggaauugaaugucuggaagucuuagaaauacaggauauguaguaaaugguugaauggcaagccccuuccucccucccucccucccucccucccucccucccucccucccuuccuuccuuccuuccuuccuuccuuccuuccuucugcaagacagucggcaaaacaggggacagaaacaggcagaauuuugaguuccaggcaagcagggaguaguacauagugaaaccuugucucaagaccguuguuauggucaugcucaaucagauuucuuagaaaagcucaggugcugaguccaguuuuuuuuuuuuuaaaguauugaaagccaugucuccuuauuucaggguuuaauguuuaucuuugugugugcgcgcacccauuaagcaugcuugguacccucauacuagaauguacuuggauccccuggaacuggaguuaaagccacaugugaauguuacauguuacaagaguaacacaugugcuuaacuuuugagucaucucuccaguucuugguuguuuguuuuuuuuuuuuuaagccuaucuaauguccauuuucuugugcucaaaguuagucucuuaauguagcauuggguauaaaggaaugcuuaugauuuguuugcuuucaagguugucaucccucagaaaaaaggcaaaaaggcuaccacaaccccagcaaagaaggugguuguuucacaaacaaaaaaggcugcaguucccacaccagcuaagaaagcagcugugaccccaggcaaaaaggcaguagccacaccagcuaagaaaaacauuacaccagccaaagucauuccaacaccggguaagaagggagcugcacaagcaaaagcguugguaccaacuccugguaaaaagggagcugccacuccagcuaagggggcuaagaacgguaagaaugccaagaaggaagacagugaugaggaugaagaugaagaggaugaagaugauagcgaugaggaugaagaugaugaggaagaggaugaguuugagccaccaauaguaaaaggagugaagccagcaaaagcagcuccugcugcuccugccucagaggaugaggaagaugaugaggaugaagaugaugaggaagaugaugaugaagaggaggaagauggugaguuagaucuuaggauauuuaggguacugcauguacauucccucacuguuucauuagauuaaaaacucauuuugugcucuuaguucuuuccauaacuuaauagguuuucauuugcuaaguaguuuuuguuuuuuuuaaguauuuguagcauuuaucuugucuggauugguagguagcaaauacauuugccugauuugccaucuuucuuccagacucugaggaagaaguuauggagaucacaacagccaaaggaaagaaaacuccugcaaaaguuguuccuaugaaagccaagaguguggcugaggaggaggaugaugaggaagaggaugaagaugacgaggaugaggaugaugaggaagaggaugacgaagaugaugaugaggaagaagaggaggaagguaaccauauuaacuuuuaaaguaugcugaccuaaguaaggcuuacuggcuaugcuaaagugucugcuuacucaugaauggcauuuuaaaacaucuagaaccuguuaaagcagcaccuggaaaacggaagaaggagaugaccaagcagaaagaagccccugaagccaagaaacagaaaguagaagguaagccugcaaaacuggggaaacagaucagaguagcacuagcacaagugaugagugacaaagggacuuaauacugaaccaugggguugaaaugaaauaugcugaugugcuuuauaguuuaugaugaaauuuguugugugcuuaagugggcugaaaguucauuuuuugugugugcaggcucagaaccaacuacaccuuucaaucuguucauuggaaaccuuaauccaaacaagucuguuaaugaauuaaaauuugccaucagugaacuuuuugcuaaaaaugaucuugcuguuguggaugucagaacugguacaaauagguaaguuuuaauugaauguuacauguguaucagcuagaauuuuuaguuuccaguuguauucuucccugccuuuaaacauggggcuauaucuaacuauguuaguaaaagucaguugucuccucucguggccuuaaguacaguuaaggagcugcaguaagaaagacuauaguauugaacuaaaugaucgagucauagggccugcaauuugaaguuccuguguuugacuugauaaagauaaaauaaaauuuaaagaagaaaagauauuaaacacauaaaauuuugugcaguaucuacaacuauggaucugcauagucauaugcuuuuagcuaaaaguauucucuguacuuuuagcgggguccaugcuagcuacugcuguuaguuacaauauacugaaugaagaaaucgaggugaauuuguuguaaugucuugguacauggacuuguuuuguuuuuuguuuuuuuuucuuuaagauuuguuuauguauaugagcacacuguagcuguccagaugguuuugagccuucaugugguuguugggaauugaauuuuuaggaucucagcucgcucugcucucaguccuugcuugcucuggcccaaagauuuauuuguuguuauacauaaguacacuguagcugacuuaagaugcaucagaagagggcauuaggucucauuaugggugguggugagccaccaugugguugcugggauuugaacucaggaccuucagaagagcagucaaugugcuuacccgcugagccaucucuccagccuuuggacuugguuuuauggaagauaagggugaucuaguuuuauuuuuguuagugcuguagaugcucugugugugugccacaugguauaagugcagaucaccuucucauaccuguaaucuuguuuuuuccaucuucaaggaaauuugguuauguggacuuugagucugcugaagaccuagaaaaggccuuggagcucacugguuuaaaaguguuuggcaaugaaauuaaacuagaaaaaccaaaaggaagagauaguaagaaagguauguaagggggucugggugacuggauacuaacagacuuaggcagucuggugccucuuccuuaguuucauccucauugugaaccaaugagaugucauaggucaugugcuuguugacagguuugauuccugggauauauaaugucagggcugacaggaggaauagcuuagugaguaaagaugcuugcugcaaaauguuugaucucuagaagccacaugaagagagaagaaccuuuaaucccagcauuugggagacagaggcaggcagauuucagaguucgaggccagccuggucuacagagugaguuccaggacauccagggcuacacagagaaacccugucucggaaaaaaaguuuuagcuuauccucugaccacauguguaucgugacaugcuugaagcuuaccuaucucuuaaaugaauucuugaucccuauauuuugaguuucagaauuuggauuuuaaguguuuguuucuuaguugugcugaaaauugaacgugggcuuuucacaugcuaggcaaauuuguuggguuuuuuuguuuguuuuuuucucaagacaggguuuuucuguguagcccuggcuguccuggagaccaagcuagccuugaacucagaaaucugccugccucccaagugcugggauuaaaggcgugagucaccacugcccugcuaggcaaucacucuuaaaacugcuacauauccucuguccccuuuugcucauuuuacaagguugcugugugcucaaucugcagucuauguuauaugcuuacuggaucuaggcuuuugauguagaaugaaccauaugagugaugagguaucuuagagauggaaacuaagucuaaauagacuuguuccauauacaacuuaauacauauggucuaaggaacaugauauacauguaaacaaguaggaaggagauaagucugguguccagggaagccaggagagccucaucugaaacuggacagggguuugugagucaucaggugacaauugaacauggguacucuucaugcaaaugguuaguaaccauugagccaccucuccaucccuuuauaccauuuuuuuuuuuagcauauauccuuguacuuuauaggaauuauuugcuuuauucucuugugacuuguaaauugauguacuuaauuaaaucuuuuuccaacauaguucgagcugcaagaacacuucuagccaaaaaccucucuuucaacaucacugaggaugaauuaaaggaaguguuugaagacgccauggagaucagauuagucagccaggaugggaaaaguaaaggguaguuuugugucuuugaguguuaaaguuuuauuaaguuuagugucuucuuccccucuccuuguccuugacagucucuagucugcugcuucaaacuuaacuucauaaccagaaaauugaauaucugguccucuggccucuaccucccaaguucugacauuaaaaaugcucaacugauggguuuugaaggugugaucaauuuuacaggcucaauccaaauuggcaucuuuugccacaaguacuauccuucccuauuuuaugagagaaaugugauucuaggcaguucagucuauuguguuggcucuuuuuccuccucaccaguuuaaaggaugaagaugagcuaauacauaguaaaagaacaguaaaagcacaugugacuaaguccuucaugucugaugcuugaguaauauuuucucuaacguaguaacugaauugucuuguacucuuucaggauugcuuauauugaauuuaagucugaagcugaugcagagaaaaauuuggaagaaaagcagggggcagaaauugauggacgaucuguuucacucuacuauacuggagagaaaggucaaaggcaagagagaacuggaaagaccagcacuuggagugguaaguuaaaggguuuauuguguagugggaacaggaaucauuuguaucuuuguauuuuaaguaauugguuaccuacaauuaguucaccuuuguucauauagcugauguuuagucuucaugagugaaagcuauuugaaaucauuuccuuuggaguauaguaggcaaauaaagcuuuuuguuggguauguuuuguacuuuaaauggcuuaaacuauuuuagaaaauaguguaagacaacaaagaacaguuaucuaauuagaaugaaaaugaaaggagcaaagaaggcauuacuguauauaauggauauacacuggugguucuagaauuaugguauaugguacaugguugaagugccauuguuucaguuaacauuccaguaaccuuguggauuagguuggagacaugcuuuauaggugacccacuuacugaguguuuaaauauacacagacauacucuaacauaccuugcuaauguguuaucuuuguauuugcaggugaaucaaagacuuugguuuuaaguaaccuuuccuacagugcaacaaaagaaacucuugaggaaguauuugagaaagcaacuuuuaucaaagugccccagaacccacauggcaaaccuaaaggguaaaauaauuuuuacguuagaugugggcuggacauacauacucuuacguauaagaguaagacuguccuguuagcuuaaaaaaaaacuaaaguuuuagcuauacaaagggcaguaaauauugauaguaaauuacaugcugaugccaaguguuucuaagcuuuauucugagaacugacuuucaaccuucagguaugcauuuauagaauuugcuucauuugaagaugcuaaagaagcuuuaaauuccuguaauaaaauggaaauugagggcagaacaaucaggcuggaguugcaaggauccaauucgagaagucguaaguccuuugacaugauaugacuugguugggugauuuuuuuuuuuauuuuuaugugccuauaugcucauuuggggcugucuuuauguuguugcugagaaaaugacaacuggauaugaugacugauuaccugagaaauaauugaugaaaucucaagaaaauuccucuagauagucaaguucugauccagcuaugucaacucaaagcagcaaccuugauugcccucugaguacgcuuuuuuuuugauccaguguagucuuuuuuuuuuuaaccuuaauuucuuguguuaauugcuuuuucugguaaaagggggaaaaaaagacauaacaaaaucaguguaagggaaggcucagugguugagcacugagaggaccuggguucaaaucccagcacucacauggcaccuaucgagacaggauuucucuguguaguccugccugucguggaacucacucuguagaccaggcuggccucaaacucagaaaucugccugccucugccuccuaggugcugggauuaaaggugugcgccaccacugcccaacccugucuguaacucuuaagaucugacauagauugcagacaaaacacuaaugcacauaaaaaaauuuuuuuuuuuaaaaaaggaaucuacuucagcugaauguggcaguauggcaguauucaccaaggguucauagugaaacaggaauuuuucucuuccagaaccauccaaaacucuguuugucaaaggucugucugaggauaccacugaagagaccuuaaaagaaucauuugagggcucuguucgugcaagaauagucacugaucgggaaacugguucuuccaaaggguaagaaggcguaguaguguugcugcuuuuuagugaauucugcauggagaacuugggucugcaguaucuucucauugagcuccuuucuguccaucagugauagauuauggauucgcacgagaagaagagagaauucacagaacuggcacuuaucuucuguuuuugcagaaguauauuuggcuguugugugagacauuaugagauacuggcgauuuucucgaccugaagaguacuuuggucacucuacuugggugacuugguacuuauuguguuacuuuaaaauguguuuacuuaaugggugagguuuuuuuguuuuucuuuucuguuuuagguuugguuuuguagacuuuaauagugaggaagaugccaaagcugccaaggaggccauggaagauggagaaauugacggaaacaaaguuaccuuggacugggccaaaccuaagggugaagguggcuuugguggucgagguggaggcagaggagguuucggaggcagagguggaggcagagguggaagagguggauuuggaggaagaggccggggaggcuuuggagguaaggaagggaaaggaacuggaaacggauuccuaaaccuguguccuaaccaaccaccuuaaaugggaaggucaguccuaauuguaucacccuuugauguuuuuccuuccuauagguagaggaggcuuccgaggcggcagaggaggagggggagacuucaagccacaaggaaagaagacgaaguuugaauag

SEQ ID NO: 85 - RNA, 3889 nt, Homo sapiens
uuagacgguugcgcgcgcagaggguugguaguugucgcuguaggccuucgcugccgcuucugcaucgugaaucgggggaccuuggcagccagaccucguuccucuuagaguagcucucaucuagucgccacaacuccgccaccauguuugaggcacgccugauccagggcuccauccugaagaaggugcuggaggcucucaaagaccucaucaaugaggccugcugggacgucagcucgggcggcgugaaccugcagagcauggacucgucucacgucuccuugguacagcuuacucugcgcuccgaaggcuucgacacauaccgcugcgaccgcaaccuagccaugggcgugaaccucaccaggugagcggguggcgggagcggggccccacucuucccgcuuccgcucuuggcggggcugugacucugcacgcucauuggcuggcuuggccauccgcgcuuucugauuggucuauggugucgggggcagcccucaccaaagcgcgcgguuccgaaaagcccgcgcuggcaguggcgcccacucuguuuccgcgccaaagccacaaagcgggaguccgcgggaaaaugagugcuccggagcugugcucauuaaaugccugcagcuuugaguggcuggucuuagcgccuaauaaacgagucuuagugcaaauguaaugucgacuuagagugacaauagaccuuuucuugacuuccagagucucacugcgcaucauggauuugaggggaaaucugucaguuuuagcuuuuaacuuugcuacagcuaccuagguuagugccuccuguauacguguucaaggacagugugugacuuauuuuaguacagauacauggauuagugccacuuguauacauuuugaaagauuuacgaaaaggccagacgugauggggcacauucuccaguacacuagaaaccaaggacaccccgcucaaaaagaugcuuucucgaauguuggcuuuuagugcauuuuacuaagucgguuuuaagaaucacauauacccgguaauuugcuucaccccugagagaguuugggguacccuuagccccuuuaacaguucuccaaccgugagugugaaaugguacaacuuguaauugcuuuuuaaaauauagauguggauuacauguugauaaagccugucuuuuuuuuuuugggggguagcauguccaaaauucuaaaaugugcugguaaugaagacaucauuacauuaagggcugaagauaaugcagacaccuuagcacuaguauucgaagcaccaaguaaguuaaacaccuuuaaaacucggaguuacguguuguuucuguuucucaaaaccaaaaaaaauauuaacaauauuguaaauuccaucauagauaggaccguguggugugcuugguaacauuuuccuucuuuugguagaucaagagaaaguuucagacuaugaaaugaaguuaauggacuuagauguggagcaacuuggaaucccagugaguuaccuuguuucugauuguguguuacccugcugugauaccagcugaugcguguucugaguggaguggugguauuggggaugaauggcacacugccauuucacuaaaccacagcagucuaaaguugauugaguuuuaaagaaaccagaagucuugcauucugaguucugguuaagaugcuaaaucuugagaacaugaagcugagccuucccccuuuucuagacugaccuuuaacuuguggguuuacaggaacaggaguacagcuguguaauaaagaugccgucgggugaauuugcacguauaugccgagaccuuagccacauuggagaugcuguugugauauccugugcaaagaauggggugaaguuuucugcaaguggagagcuuggcaaugggaacauuaaguugucacaaacaaguaauguggauaaagaagaggaggcggugaguaguaagggggcguccaguuaggugucugaagcagggauggagccucggcuuuuguuuuuauuuauucauucauuuugagauggagucuugaguagaccaagcuaucuuagagcucagagacgacuccauaagcuuuuacagguagcauuuggaaagcuaaguguacagccuuuugcuuccuggaaauacucuuggcaaauaagugaggguuggcaagugagcaaaagaaaaugguuggggguguauguagcuuuauguguugcagguucaagaguauuugcagucccaagggaaauaagaaagacuucacaaaauguggaaagaguuguauuaaaugcucuugacaguuacauccauagagaaagcugggcaugaugucucaaacccacaacugauguacucaaagcuacagcaggaagauucucagcuuaaagucaaccuggcagaaaaucuagcucaaaaagaaugaggaagaaauugggaaggcaaaggaagauguucuccgaguccuccucauucaaguagaacauacuaggccucuuuaauuucuaaguaucccugaaucgaggcuuuuucucaggaauccaauguauauuucauggcuacacuuuuuuuuuucuuuuuuaaguuuugcuagcuagccugagcaucagaauuacacacagaagucugaacuaaauaggauuuuuaggguuuaguauagugaaauucagagugcuucugcaaguauuuaagguaaauauaagguguuacuuggccucugcaugaauuuaaaguaaaugaaaguguaagaauucgaacauagauaaacacacaacccaagaacuaguucuuaaccuuaaucugcugaauuauuucuacuuccauaucaacuucagcuccucaguucucaaauacugacauguaauucaucaguauuugucugaugugcaagcauuuccacaacaaaagaaauuaaggaauuuuucaguauccacauguucaaggauugggaauugaauaaaauugauaaucauacaaugaagacugguuuacugucccuuagcuugcauucagcuguugguucuuguuuuuggaagugguuauguguuaucuuccucucuucaugcauucuuugcaagagaaguauguacaaucugaauaggaacaacuuucuccuuuguuuugauugcuugggguguggcucuacaggaugggcaagcuagacuuuuuucuucuuuagucaagguuuucaucaacccuuccaaaaugauaacuauuuguuuugcuuugugguauaauaccgugaucuaauagugugaguuucugaugucuacagugagccuguuuucuccucuagguaaccauagagaugaaugagccuguucaccuaacguuugcucugagguaccugaacuuuuucacaaaagccacuccacugucuccuacaguaacacucaguaugucugcagaugugccccuugguaagaugauaaguuugaacauuguuuuguaaugugguauuuauaguauucggugguuuaauuuuuccugucuuucaguuguagaguauaaaauugcugacaugggacacuuaaaguauuauuuggcucccaagauugaagaugaggaagcaucuuaggcauugcuagaaauugagaaaacuaaaccuuugaagauugcuccugagaugccagcguguccugaggucuuuucugucaccaaguuuguaccugaguauucuuaaauauuaaaauaaaauauguagauaucuucuguaaauaaccuacuuucuuuucucuccauucuccauaauuugcuuaaagaauaagcuccaaaguaaaaacuaguuuuguuaacaugaauguuucugcuuuacaaauacuggugauuuuccaucaaugaucuugacgcuaaaugcaguuuuaagaaauauuguucaauuuaaauaaaguuaacaauuugaaaaguca

SEQ ID NO: 86 - RNA, 1720 nt, Homo sapiens
ggugcaggauguaggccugcagaauugucagacccaguggcggcuuuugccacuggaagaauuuccaacauaaaacagaugaucaguuugggacaaucgauucugcgaccagagguagugucauuugguuacuuuuaaaauucagauugucugguguuuuccaaucacucgcgacuguaauuugaaguuggguucugagauaauacaaucgcugucgcucuaguuuauaaagcuguccaagaucugcccagucccagauguccuggguccucagggccgcuguggucugccaacuucugcagcuggaugccagaccauccuggacucggaucccuuuggguauuucuacaccgcugugucccggccuggccuuggggagcccugguucauaaucgucggcuauguggacgacaugcagguccugcgcuucagcagcaaggaggagacuccgaggauggcacccuggcuggagcaggaggaagcaggugacugggagcagcagacucguauagucacaauucaaggacagcugucugaaaggaaucugaugacccugguucauuuuuacaacaagagcauggacgacucucacacacuacaguggcugcaaggcugcgauguggagccagaucggcaccugugucucugguacaaccagcucgccuaugauagcgaggaucuccccacccugaacgaaaacccaaguuccuguacagugggaaacagcacuguaccucacaucucucaggaccugaagagccacugcucagaucugcugcagaaauaccuggaaaaagggaaggagaggcugcugcguucagacccuccaaaggcacaugugacccgucaccccagaccugaaggugaugucacccugagguguugggcccugggcuucuacccugcugacaucacccugaccuggcaguugaauggggaggagcugacccaggacauggagcuuguggagaccaggccugcaggggauggaaccuuccagaagugggcagcugugguggugccucuugggaaagagcagaguuacacaugccauguguaccaugaggggcugccugagccccucauccugagaugggagccugcaugguaccaaaagccuuggauuuggauuguugccaugguuuucauuuuguucaucauuugucucugugugguuugcauaugcaugaagaagaaugcaggugggagaggaaggcgugacacccaagaagcaggcagagacaguccccaagacucuagcaagacuguuguggaugaugaggagauggggguuugcuuuuggaagauuaaguccuguaaaacuugucuaggccacuccccaggaacuucaguuggcgagucuuuacugucaccuugacuggauuuaggaucaucugggagaugccccuuugaguggcugggcugugaggacagcaggccaguucuugccacccuggacagaaacacaucucaccuuucuggcucaaggaucugaacaccugucucuugccuacucggcuucuagucaggcauuuugucaccuugucaagggucccagggacacaaagcucccuccucucacccacagcacucuggguccuacccucagugcuucagggacauuuaaucaggucaaauugggaucaauggcuuugaugcagaaaagaacuguggacuaauagagauaggguuuaauuaaaaaauauaucuuuuuaauuuu

SEQ ID NO: 87 - RNA, 367 nt, Homo sapiens
cuggcacggacauggcugucuucugucugcugugugggaaacgcuuucaggcacaaagcgcacuccagcagcacauggagguccacgcaggcgugcgcagcuauauuugcagugagugcaaccgcaccuuccccagccacacggcucucaagcgccaccuucgcucacauacagguuuuuuucuccaugugucaccaagugaaguuugugccuucuauagcaaagagaauauuuuuuacauccuacuaacaguagauuuuuuuguagugaacauuuuuuguauuuuuauuuauaagucucauaagaaaaauagcgauguucaguuguauaccuugaaucugcaguuagaagagaauaaaguuaacuc

SEQ ID NO: 88 - RNA, 7879 nt, Homo sapiens
  misc_feature (4457)..(4460): n is a, c, g, or u
  misc_feature (4471)..(4471): n is a, c, g, or u
ggagccccagugcaggaggcugcgaaaguugggggagugugcuagaaggacugcggagcggagcgcacgcgggaccaggcugcgacugggucgcuggucccggccacagggagugggagccggcuggguagguaccccgcagggagcguguuucuguuucuagggacagugcaugaaagagaugggguguacgcgcgggcgaaaaggaaggguguuuucgggucggcuuacgaggagggguguguagggugcauuuuugguauuaaaggauagcucuuggaguagggugagccagggcuugaaguuuaggaagcgggcgaagggucugcaaggugcuugguuuugguagguagugggcgcuuguuuaggagguuuccccgcuaggaucuccagugugaggcacucuguacucuggguuuggguguugauugccggguaggggguugucugagcauggacugggaaaagguacucagagcuucggcguugcuggggauccauccaaguacaaguaagauuggauuuccacgggucuccuucccggcucucagcccccuuucccaguguuuacuuaauacuucauaggcuguacuuagauuuucugauucccuuaccgaacuuucuuucugaaccgugcuggaagaccuggggguugcugaaggaaauggccagcuagguuggcuggguaaugguuguguuagacuaaguugucagaguaucuagaaaccuaggagcuguagccuggugcagcuacugaaagccgcacguggagccuggguggaaguugcucacgauagagucucgauguaguacugacuaggggggagaccccuucugucaucagacagacuuguauaccccaguggucuuuugaaucuguuagguagggugcagccugcgggcuuggucaccuaacagguguugccaggaccugccccaagccggauucucccacucccucuuucaaccccgccucuuccuccuccuugagacacccccacccccucaggaggcuagaugcagaucuguaucuuguguugcugacuaucggccugaagcuggguagauugguggggguugauccggauguaggauguccaaguggagaaacaggauuugaauggagcuggaacaaacgcccaguccugacugcugccacccuucuuccuccacccccaacccaucccuucccaggcuucuugcaaacagaggcagaaguggccauauuucuuucuuucucccaggugcuguaugcccuagggacuugacacggggcaggcggggugggaacugguuggggggggacgugcuguuuuaugggaagucguaugccuagccagcgguggagcuguccuggcuaggcacccaggggugguguggggaaugggagaaauacugggacuagagggucucaagggccagcagguggugauagucuuuuucuccaccccacccucugcuccaccaccccucugccucagcaccccucugcccucagcaccccucugccucagcacccucugccuccagccacccucugccucagcacccucugccucagcacccucugccucagcacccucugccucagcacccucugccucaguguuccugugugaccugucuuuucaacuagaaagucuagaacuguacagaccccagaguuggagguggaaagggacacuagguccuggagccuccucugugggcuuuuuugaccagaugagaacguaagggccuccuccagcuaucccuggucauucaggugcuucagguuugugaccuuugcugagacccuggaugcugcagcaaacagacaucugcuuuagcagagggacagcuugucucugugcauccgcugguaggauccuccacucuguccaauuagcuugcgcugcugcuggguucugaguguucucuuacaaaaugacaagguuagggggcuggagagauggcucaggggcuaagagcacccauguggcaguuugcaacugucuguaacuccuguuccaggggggaucugacacccucacacggacaaacaugcaggcaaaacaccuauuggcauggaaaaugaaaauaaaugaccggguuagcugagaaauuccuuuugagaguugucuuuucuccaguccaggacugcucucuggaucuuccugcucaguuccucgccucccuuccauauaugguauuuaagguuuuacuuuuuuuugcguuuucaauuguuuuuaauuguauuuauaugugucucugugugugcacaugagcauggguguccuacaaggcuagagacaucagauguccuggagcuagaguuacagaugguugugagccaccugauguaguugcugggaacuggauuuaguuccuguggaagagcagugcaugcucuuaaccacugagcaacuucuccacgcggcccccccccaguauacgguauuuaaaacucuauagcaaugcuacccaacccauuguggagcuggggauggugagguggccuaguuccccccaacuccuggaaacaugucagaaaguacagagugggugccugugggaucagcaugcgggggguggugguggugagguguggggcugcuuucucccgaggcuaccgugauagacaguuguaccuugcuggcagccucuaccccauuuccaggaugucagucucugcagacguaugggggacgguggggaagggguauacagagccaugggugugccugggaauguacucccaggaagugacugguugaaaagucagcagaucuccugggggauagaggggugggcugaagcucuguggguugccucucucagcccugaccugugaacagggaggcuggggguuggaggaacacagcuucccccuguuccuggggggacaugcuggacagccuuuccuagcucccccggcccacugggguguggcuggucgucggacugagcucuuuuggaccuggucucugccugugagcuuugugacucguugagauagcauuugggcugagggauugggagucuucuguucuuugguccugacacccgcuuccuugucuaggccugccaccuggcuccccccaccccccuccccggccuaccaaguuucuugcuucccuuacugaccccuccuccucccuccuuugugucuccucccucuccagagaugcccuguauucaagcucaauauggaacaccagcaacgagcccaggaccgcgugaccaccugaccggugauccccuggcccuugaguucggcaagccuaccauggaccuggccagccccgagacagcaccugccgcaccugcuacacugcccagcuucagcaccuucauggacggguacaccggagaguuugacaccuuccucuaccagcugccggggacgacccagccgugcuccucagcuuguuccucugccuccuccacgucuucuuccucauccucggccaccucccccgcuucggcguccuucaaguuugaggacuuccagguguacggcugcuacccgggcacccugagcggcccauuagaugagacccuauccuccagcggcucugaguacuauggcagucccugcucagcccccucgccaucuacacccaacuuccagccgucccagcuuucucccugggacggcucauuuggccacuucuccccgagccagacuuaugaaggccucugggcauggacagagcaguugccuaaggcuucuucagggccuccgccaccuccaaccuucuucuccuucaguccucccacuggccccagccccagccuggcccagaguucucugaaauuguucccaccaccagccacccaccagcuuggggagggggagagcuauuccaugccagcagcuuuccccggcuuggcacccaccucuccgaaccgugacacuuccggcauucuggacgcacccgugaccuccaccaagucccggagcggggcuucagguggcagcgagggccgcugugcagucuguggugacaaugcuucgugucagcacuaugggguccgcaccugugagggcugcaagggcuucuucaagguauuuuguugguucugggggacgaugauaucauguuggagguggggguggagugggucauccguugggaucuguagugaccucuccugagguuucuucccagcugguucuguccugcaggacgagggacaggugugugccaucuuagaggcugggacuuuuuauucagcagggcacacaucucucuagggcugcagaaagcuggggaagggggcagaagguguguguguguguggccugcaguggugcucagaaacagaaaaccuagugggcagccucugguucuccacagaacuuguguuucuggcacuggaugaaaggacacaggcagaggguuugguucuugcuggggguggacuugggaacaggcuguguguuugucccagugcugggugccugcuuggcnnnncccaccuccanccccuuaguccucuccucugcgccaggaaaagggcagguggacacaugcagacaccuguuagaacaggugucuggacggccgugggaguuccuagacccuggucuuggguucugggaucuucccugugagguugaaaccuucuccaguaucucccagacuccucucugcgcucuggcccuccguuucucccucccccuacauccaaauguuaggaaaauagcuaugaacagagggcgcuuuugucugcgucggccacaggaucuggacgguccccuccccugggcucuccaccccccccccaaaccccaugcucugacagccuguuccguguccccccuuccuccagcgcacaguacagaaaagcgccaaguacaucugccuggcaaacaaggauugcccuguggacaagaggcggcggaaccgcugccaguucugccgcuuccagaagugccuggcugugggcauggugaaggaagguggguggcaagauggugcccucggcauaggcgaccugauggggugggacagccgggcucaccaggaucugcaccuaauucccacucccacuucuagauuccagccccuaaaugcagguguagcuuccaccugcuuucuggaaaggguggggugaggagggccuugugggguccccaucauggucugaguucucugucucugacuucucagaagugggguguauagugugcccugaagacccuccuucuccaggucuccuuucucaauacugcccgucucucugcaguuguacggacagacagccuaaaagggcggcggggccggcuaccuucaaaacccaagcagccuccagaugccuccccuaccaaucuucucacuucccucauccgggcacacuuggacuccgggccuagcacugccaaauuggacuauuccaaggugaggucuugcccgcccaucugcccugcccugagaacauaugcaaugccuuugugccuguuaggaaaggcucucccuccagggcaacaucaggaaacaagcauccucuauguacuggcuaguuggagaaaugcauugggauggguguggggucggggagccaguuacaaacagcugccguagcccuguuuuccugugggaauugacaagcacaugggcccagaauagggcucuuuugcacgccuggaucuggugucccagugcaugagagcucuguaaugcagcuuguguaggcuuugcuguggacccaaugcaggacacagcugugugaugcaggccuugcuguggagccagugcgugacacagcuguguggugcaggcccucauguggaacuuaccugcguuccuuucaguuccaggaacuggugcugccccgcuucgggaaggaagaugccggugacgugcaacaauuuuaugacuugcucucugguucccuggacguuauccgaaagugggcagaaaaaaucccuggcuucauugagcuuugcccaggagaccaagaccuguugcuagagucugccuuccuggaacucuucauccuccgccuggcauaccgguaagcugcccaccauccuccuagcccuggccccagcccugcggccccggccugccuggacccugaguccugacuguucucugccuucugccagaucuaaacccggugaggggaagcucaucuucugcucaggccugguacuacaccagcugcagugugcccguggcuuuggugauuggauugacaacauccuggccuucucacggucccugcacagcuuggguguugauguucccgccuuugccugccuguccgcucugguccucaucacuggugaguggcagaaacuagacugggcccaaggguugcaggaccauuggguagguagcaucuaacacuuuggggaccccuagagugccugcaacauugggauguuaggaccugcaaagggacuuagcucuauucgccccuaaagcuuaaaucagccuccgaaugaccccggacuccucagguacgacuguaggcgcugggcaucuagcuuagggauucuguuuguuuaaaaaccuagcugucaaccucacaagacacaggaacgugcacacaugaauuuuucacauucugcgcuuggauagcuaucgccaugguccagaaacaggaccuacuucagcucuguugggcucccuccuuauugucucuguaagagguaaccacucugccagccucaguggcauuccugucauggauuuuacugugcguaucacaggguauggacucuaguguuaaauguagagguuucugggucccuucucguuccgcucccauuuccacuuaaauuucuuaggggauccuccugaguagaucaagaccaggagcuggaucuugaaaggguagggagugauaucuacacccagcucaguccuuagucuguccugcgagacuccaggauuuuagaacaguguggagccuggaccuccagaaaaccuggauuaggcuuuugccuuggccagccauucagugguuucaaauauugaccagucuggacagugggcuccugugggacgugcuagagggcuggggaagcuugucagggagaaggcgucaacugagcggggcugacucuaccuucccugcugcagaucgacacgggcuccaggacccucgucggguggaagagcugcagaaucgcauugcuagcugucugaaggagcacauggcuaccguggcaggagacccacagccggccagcugccugucacgucugcugggcaaacugccugagcuucggacccugugcacucaaggccugcagcgcaucuuuugccucaaguuggaggacuugguacccccuccaccuauuguggacaagaucuuuauggacacauugucuuucugaccccugcccugaacaugugugcgcacacgugcgugcucuucugucacccaugugccuuuaagccuauagcccacggacccccagaccacccuacccccagccugguuuugagcuaagacugacguaccuccucacuccagaagauggacagagaacucaagaccugggggaggguguguauucacgggggugaccccacuauuugucuuaucccuccagcucaguccuggccuucguguguuuuuguaagauaaaccauuuuuaacacauaccacucuguuguaaauaagcugacgcuacuguaaauacagaaaggaagagguugagauggggguugggaggaagggguggggcucccaccagcugggcgagccuccaacucgagaucucuuccgcucuccuuccauguguacauaacugucacucaagaaggugauugacagauucugauuuauauuuguguauuuuccuggauuuauaggaugugacuuuucugauuaauauauuuaauauauugaauaaaaaauagacauguaguugaaa

SEQ ID NO: 89 - RNA, 586 nt, Homo sapiens
ggcacgaggcugugcccgccaugucugcuacccaucacaagaccucccugccucagggcguccgcgugggcacugucaugagaauucgaggcuuggucccugaccaggcuggcagguuccauguaaaccugcuaugcggugaggagcaaggagcagaugccgccuugcacuuuaacccgaggcuggacacuuccgagguugucuucaacaccaaacaacaaggcaaauggggccgugaggagcgaggcaccggcauccccuuccagcgugggcagcccuuugaagugcuccucaucgccacagaggaaggcuucaaggcuguggucggggaugacgaauaucuccacuuccaccaccggcugccgcccgcccgcguucgcuugguggaagugggcggagacgugcagcugcauucauugaauaucuucuaagcaaaggacccaagggccuuugcccgguuacggguuggggguuuuuugaucccacaagaaagguuuuggaucggccaauaacauuuuucuguuguucugaaaaauuaaaaaaaaaaaaaaaaaaaaaaaaaaaaaaaaaaaaaaaaaaaaaaaaa

SEQ ID NO: 90 - RNA, 540 nt, Homo sapiens
gccacauuguugcaccaacuccagugcuggagucucaggacaccacaggcuacccggaguuguucugcuuuggagauccgagggcaggagcaucacgccagugacucugauaggugcgaucgccggauuggaacagaacugucauuuuuuuccgaaguugagccuuagugacccagugagugaaguuagcgacgggacgcuaagcagcuagaccggucggcaggagugagacuuaggguaccuucuaguaguugugauuaaaaaaauugaaaaaaagaaaaaaaaaaacccuguuucuggaaacuugaggcccucagcuggugagccaucgugguuaagcuucuuuguguggcuccuggagucuucgaucccagccggacacccgggccugguuucaaagcggucggacagcgcugccugcuccaucgguagcgcucgagccucgguuucucuauuuggccccgacucgccgcaacaagaugaucgccucgcauaugaucgccugcuuauucacggagcucaaccaaaaccaagugcaga

SEQ ID NO: 91 - RNA, 2000 nt, Homo sapiens
cccagcuguuucguccguaccuagaccgcgguuauggcgucguucacggugaaggccuaucuucugggcaaggaggaggcgacccgcgagauccgccgcuucagcuucugcuucagcccggagccggaggcggaagcccaagccgcggccggcccggggcccugcgagaggcugcugagccgaguggcugugcuguuccccacgcugaggccuggcggcuuccaggcgcacuaccgcgaugaggauggggacuugguugccuuuuccagugaugaggagcugacaauggcuauguccuaugugaaagaugacaucuuccgcaucuacauuaaagagaagaaggagugccggcgggaacaucgcccaccaugugcucaggaggcaccccgaaacauggugcaccccaaugugaucugugaugguugcaacgggccuguggugggaacucgcuauaagugcagugugugcccagacuacgaccugugcagcgugugcgaggggaagggccugcacagggaacacagcaagcucaucuuucccaaccccuuuggccaccucucugauagcuucucucauagccgcuggcuucggaagcugaaacauggacacuuuggcuggccuggcugggagaugggcccaccggggaacuggagcccacguccuccucgugcaggggauggccgcccuugcccuacagcugagucagcuucugcuccaccagaagaucccaaugucaauuuccugaagaaugugggggagaguguggcagcugcccucagcccucuaggcauugagguugacauugauguggaacauggagggaagagaagccgccugacacccacuaccccagaaaguuccagcacaggcacagaagacaagaguaacacucagccaagcagcugcucuucggaagucagcaaaccugacggggcuggggagggcccugcucagucucugacagagcaaaugaaaaagauagccuuggagucggugggacagccagaggaacagauggagucgggaaacugcucaggaggagacgaugacuggacacauuugucuucaaaagaaguggacccaucuacaggugaacuccagucucuacagaugccagaaucggaagggccaagcucucuagaccccucacaggaaggacccacagggcugaaggaagcugcccuauacccacaucucccaccagaggcugauccccggcugauugagucccucucccagaugcuguccauggguuucucggaugaaggcggcuggcucaccaggcuccuacagaccaagaauuacgacaucggggcugcucuggacacgauccaguauucgaagcacccuccaccauugugauagugcuguggccaagccccacccccuuugucuuguaguugcaucacguagagcagcagggcuucuauagauaggcccagugucuuggcauucuuguagaaucuucaggugggaaugugugaugccuuuucaggcaauaggaaagugcaugaggagaguuuugaaugugcauaugcugacgccugagaacagacccagguacccguggcugagcugagcuuccucugcuuccccuaggccuggccucugcagggaacugcagcacacacugcacucccaccugcucuugccgccagcauugcaccagcaguccagaauuccugccugacaacccguguuuccuuuauuaaaagugauuaguacaacugcuaguuauuuucaacaaauaaagccauuauguuaagaggggacuguccauagugagugaaagguggcaggcaggggccuacagcuccuagggaauggagaauucaugugaagccgaaugaaggaucuuaucuuauacugucccccuuucuaauggccacucuuuaguguuugugucuaauguuaaugcuuaaagcacaggacccccauguagcuuccucugacuugguuuguaaguaaccuguaauaaaaugccauaugcacuuuaacca

SEQ ID NO: 92 - RNA, 2649 nt, Homo sapiens
gagggaauugcgggaccccgucuggggaagcucccgccgccccggggugcucagcucucugucucccuugacccagguacagucaugucgggcuucgacgacccgggcauuuucuacagcgacagcuucgguggcgaccccggugcggaagagggccaggcccgcaagucgcaacugcagaggcgauucaaggaguuccugagacaguaccgagugggcaccgaucgcacgggcuucaccuucaaguacagagaugaacucaagcggcauuacaaccugggugaauacuggaucgagguggagauggaggaccuggccaguuuugacgaggaacuggcugaccacuugcauaaacagccggccgagcacuuacagcugcuugaggaagcugccaaggagguggcagaugaggugacccggccccggccagcuggagaugagcugcuccaagacauccaggucaugcucaagucagaugccagcccgucgagcauucggauucugaagucagacaugaugucacaccuggugaagaucccuggcaucaucauuucagccucugcaguccgugccaaggcuacucguaucuccauucagugccgcagcugccacaacacccucaccaauaucgccaugcccaggccuagagggcuaugccuucccaggaagugcaauauggaucaggcugggcgcccaaagugcccacuggauccauacuucaucaugccugacaagugcaaguguguggacuuccagacucugaaacugcaggagcugccugaugcagucccucauggugagaugcccaggcacaugcagcuuuauugugacagguaccugugugacaagguuguuccugggaacagggucaccaucaugggcauuuauuccaucaagaaguuuggcuugaaccccagcaagggccgggacaggguaggugugggcauccggagcucguacauccgagugcugggcauccagguggacacagauggcucuggccgaagcuuugcugggucugucagcccacaggaagaggaggaauuucgucgccuggcugcccuccccaacauauaugagcucaucuccaagagcauuucccccuccaucuuugggggcauggauaugaagaaggccauugccugccugcuuuuuggggguucccggaagaggcucccagauggacucacucgccgaggugauaucaacuugcugauguugggagacccugguacagccaagucucagcuucugaaguuuguggagaagugcucucccauugggguguacacaucugggaaagguagcagugcugcaggcuugacugccucagugauacgggaccccucaucucgaaacuucaucauggaagguggagccaugguucuggccgauggugggguugucuguauugaugaguuugacaagaugcgggaagaugaccguguugcaauccaugaggcuauggagcagcagaccaucuccauugcuaaagcugggaucacuaccaccuugaacucucgcugcucuguucuggcugcagccaacucaguguuuggccgaugggaugagacaaaaggggaggacaauauugacuucaugccuaccaucuugucccgauuugauaugaucuucaucgucaaagaugagcacaaugaggagagggacaugaugcuagccaaacaugugaugacucugcaugugagugcacugacacagacacaggcuguggagggugagaucgaccuggccaagaugaagaaguucauugccuacugccgagcgagguguggaccucggcuaucagcagaggcagcagagaagcugaagaaccgcuacaucaucaugcggaguggggcucgucagcaugagagggacagugaccggcguuccagcauccccaucacugugcggcagcuggaggcuauugugcgcauugcugaggcccucaguaagaugaaacugcagcccuuugccacugaggcugauguagaggaggcauugagacuguuccagguguccacacuggaugcugcuuugucuggcaaucugucggggguggagggcuucacuacccaggaggaccaggagaugcugagccgcauugagaagcaacucaagcgccguuuugccauuggcucucaggugucugaacacagcauuguccaggacuucaccaaacagaaauauccagagcacgcuauccgaaaggugcugcagcucaugcuacgcaggggugagauccaacaccguaugcagcgcaaggugcucuaucgccucaagugagcccauugcccaucaacccucaagccugaaaugcugccaccacccuaucucccagucagugcuccaaaccuccuuuugcccugccucuccaccucagacugcugucugcagcacaucugcagccccuggaaauguacuuuggucuguuggcucauacuguguuugagugucugaggacucucugcucugggugucuauccccugucaugccuucucaacaagaugagucuggagcaggaacaggcccuggaauguagaugggucuguauauuggcucccgggccacucacugccaagcuucuuuguauguacagagguaauaaagcaauugagucccuggcugcuaaggucaguggacccagu

SEQ ID NO: 93 - RNA, 450 nt, Homo sapiens
  misc_feature (389)..(389): n is a, c, g, or u
ggaugcagccggaagugcagcgugcgugcgguuuggugggucgcugugugcgcuccgcgugugcagccgcgugggccauggggcggcgggcgcggggccggcgguuccagcagccgccgcagccugagggcgaggaagacgccagcgacggcggcagaaagcgaggccaggcgggcugggaagguggcuaucccgagaucguaaaggagaacaagcucuucgagcacuacuaucaggaacucaagaucgugccagagggagaaugggaccaauucauggagucacuccgagaaccucucccagccacacugagaaucacuggguacaaaagccaugccaaagagauucuccauugcuugaagaacaaguacuuuaaggaguuggagganccugaaguagauggacagaaaguugaguuccacaaccacuaagcugguacccugaagaacu

SEQ ID NO: 94 - RNA, 929 nt, Homo sapiens
gagcucaaauucuggcuuucuauuggguacgauauauuaaccaaugggagaaacacaaacagaauaccuccaguuaguauaaaugcuugcuguucaguugcagaauuuacuauauauucuuuuccuuucucugcuuugccuuuacugauacuuaaacgcauacaugucuggacgcggaaagcaagggugcaaggcccgcgcuaaggccaagacccgcuccucccgggccggccugcaguuccccgugggccgcgugcaccggcugcuccgcaagggcaacuacucggagcgcgugggcgccggcgccccgguguaccuggcggcugugcuggaguaccugacggccgagauccuggagcuggcgggcaaugcggcccgcgacaacaagaagacgcgcaucaucccgcgccaccugcagcuggccauccgcaacgacgaggagcucaacaagcugcugggccgcgugaccaucgcgcagggcggcguccugcccaacauccaggccgugcugcugcccaagaagaccgagagccaccacaaggccaaggggaaguaaucuggcgauugucuguacugcccaguugaaaguuaaccaaaacaaaggcucuuuucagagccacccacaucuuuccauaaaaugagcugccaccucgugaaacguucuuccacuacaguuuuuauacuacauaugaaaaaguuacgaaguagcuuucaaucuuaguaaauugauuuuaauacuguuagucccugcgauaaaucuuacgaccuuccuuaguuugagucaaaaguguguaagagaugaaaccuuuagaacauacuauaaauuuuuaguagaaauuuggcacccagguuugucauucacgucacgauugucuagagcauaaugguaguaagggcuaagggccauuaaaucccacuuccauaguuuc

SEQ ID NO: 95 - RNA, 325 nt, Homo sapiens
uuuuuuuuuuuuuuuuuggaaaugaagguaauuuauugaaacugguuuugggacaggcgaguggacaacuguugaaaggagcuagcgcacagccgggugggagcgggugcuuagccacagauccuaucugaggcccaacuuuuucuuuuccuucugcuucuuacggaccacauccagguuccgguccuuccacaugcuuuugcgaagcuugauggggcgugagcccacauacuucccauucaucucucgcauggcgcgcacauagucacuggggucuuugaagcugacaaagccauagcccuugguuuugccugugcgcuuguca

SEQ ID NO: 96 - RNA, 367 nt, Homo sapiens
uucggauccuugccaauauauguaucccauuuggaauggugaucuuaaaaugugagugcaugcauacuaucuuauuuaagauacuugcaccccacccacucccaucucccgaagcuggaacacugccaacuagguccuuaagaaucacgcaauuaacacaagguugggugcugcuaauucuucaugaaaauccaaacacguuaagggaccagggagaugccacugccccccugaauuuucaucaaaaauagacacguuuauguaaacagaacuauuuuccauauucauagugacuuuuuaaguauuugagccuaaagauuuugaucuccauuuuuauaacuauuuaaauuguucacaauuauuacau

SEQ ID NO: 97 - RNA, 418 nt, Homo sapiens
cggccgccgccgcccccacacugccccgcguugacgagcgccgcgacggcaaggacagcgccucgcuuuucgugguggcucggauccuagcggaccucaaccagcaggcgccggcgcccgcccccgcggaacgcagagaaggggccgcugcgcgcaaggcgaggacccccugccgccugccgccugcgcccccugcgccgccacccggcccagagcccgccuccccgggacaagcaggcgcgccggccgcgccccccagccccgcguggagcgagccggaggcggcauuggagcaggagcccggccccgcggggagcggcgagccuggccucagacaaaggggucggggaggccggagccgcgcggaccucgaguccccgcagaggaagcacaagugccacuacgcgggcugcgagaa

SEQ ID NO: 98 - RNA, 1552 nt, Homo sapiens
cgucaguccccgccaccuccccggccccgcgcgcccggaucggcccuacggccucgucucgcccggccuugcgcgccgggaccgccgcgaucuccucuccccgccgcccuccggcuggcccugccugcugcggcgcgaugaaugacuuuggaaucaagaacauggaccaaguggccccugucgccaacaguuuucgugggacacucaagcgccagccagccuuugacaccuucgauggcucucuguuugcugugcucccuucucucagugaagaucagacacuccaagaagugcccacgggccuggauucugucucccaugacucggccagcugcgagcugccuuugcucacucccugcagcaaggcagugaugagccaagccuuaaaagccaccuucaguggcuuccaaaaggagcaacgacgucuuggcauccccaaaaaccccuggcuguggagcgagcagcaggugugccaguggcuucucugggccaccaacgaguucagccuggugaaugugaaccugcaccaguuuggcaugaacggccagaugcuguguaaccucggcaaggagcgcuuccuggagcuggcgccugacuuugugggugacauccucugggaacaucuagagcagaugaucaaagagaaccaagaaaagacagaagaccaauaugaggaaaacucucaccucaacgcgguuccucauuggaucaacagcaauacauuaggcuucagcauggaacaggcuccauauggaaugcaggcaccaaacuaccccaaagacaaucuccuggacagcaugugcccgccaucggccacgccugcagcucugggcucugagcuccagauguugcccaagucucggcucaacaccgucaaugucaauuacuguuccaucagccaggacuuccccagcagcaacgugaauuugcucaacaacaauucuggaaaacccaaggaccacgacucuccagagaacgguggggacagcuucgagagcuccgacucgcugcugagguccuggaacagccagucgucccuacuggauguacagcggguaccuuccuucgagagcuuugaggaggacuguagccagucucugugccucaguaagcugaccauguccuucaaggacuacauccaagagaggagcgacccagucgagcaaggcaaaccaguuauuccugcagcaguacuggcuggcuucacuggaagcggaccaauccaguuguggcaguuucuucuggagcuacucucugacaaguccugucaaucuuucaucagcuggacgggggauggaugggaguucaagcuugcugaccccgaugagguugcccgccggugggggaagaggaaaaauaaaccaaagaugaacuacgagaagcugagccggggcuuacguuacuacuacgacaagaacaucauccacaagacuucgggcaagcgcuacguguaccguuucguaugugaccugcagaacuugcugggcuucacuccggaggaacugcaugccauccugggcguccagccugauacagaagacugagggccuca

SEQ ID NO: 99 - RNA, 4043 nt, Homo sapiens
auggcucuaacaacgcugcucuuggugguggcggccgcccugacccugaucgagacccgcgcgggugagugcggggucgggagggaaacagccccugugccgcguccccgcuucgcccaccggaccuccgccccuucuccacccgagccccgagcccugcuccacucccggcccgcguacccgaccggggucccgggaggaggucggggucucaccgcgcgccgcccccaggcccacacucgcugcgguauuuccacaccgcugugucccggcccggacucggggagccccgguucaucaucgucggcuacguggacgacacgcaguucgugcgcuucgacagagacgcggaaaauccgaggauggagccgcgggcgcgguggauggagcaggaggggccggaguauugggagcgggagacacagaucgccaagggccaugagcagaguuuccaagggagccugaggacugcacagagcuacuacaaccagagcaagggcggugagugaccccgggucggaggucacuaccucuccacgucccgaaacagaggccggugaggucccgggugcaaaguccgagguucaggagcagaacugacccaggacuggauucccuuucaguuuggaggaguccgcgguggggggguggggggggggcggaggagggacugaccacugggucccgcaggcucucacacacuccaguggauguauggcugugacaugggguccgacgggcgccuccuccgcggguaccugcaguucgccuaugaaggccgcgauuacaucgcccugaacgaagaccugaaaacguggacggcggcggacauggaggcacagaucacccgacgcaagugggagcaggcugguauugcagagagagaccgggccuaccuggaggucgcgugaggcuccgcagauaccugcagcucgggaaggagacgcugcugcgcacaggugcaggggccgcgggcagcuccucccucugcccucaggcuggggcucaguccuggggaagaagaaacccucagcugggguggugccccuggcucagaggggagagagugacccugggucuccugaucccucaucacagugacugcacugacucucccagggcucagccuucucccuggacagugcccaggcugucucaggagggaaggagagaauuucccugagguaacaacagcugcucccuucaguuccccuguagccucugucagccauggccucucccaggccaggguucucagccuacacccacugucuguagacacugacuccuguccugcugagugugucagcccuuacaccucaugaccugaagucuccuuuacccgaugggagacauggacaucuacacuaggcugguucccccaguuucuagaacuuuccaaagaauacagucuaccagauccuucccugucugugggguuugcauccuuugacacccaauucuaucuauuccugcaauggugaauagucacaugagccauuauggguuacccuaaacaaauacuuuucuuguguuuuuccccucucguuuucuuuuuaucuuuacuuuuuuuuuaaggguauuauguugcuuauaaucgguuuuucuucggcacuggaaugauauugcucucucuccccaccauacccccacccccgccuauaucauuuguaucaguagcccuggcugucguggaacucacucuguagaccaggcuggccuugaacucagaaaucagccugccucugucucugccucugccucccaagugcugggauuaaaggcuugggccaccaccacugggcagaagaaagguuccugugagcuuaaaauguuuucuggcagaauuaaccauccagaucacuccugauaucccugugccccaccaaguuacagugcucccccuggugaaucagaacuuggacucugagagacagggucuucugcaauccaggccugagugagagggaagaccacacacccugugagcccacuguguuccagugagugcugcacugggguccacagcacauuccagggauccugugugacacaucuguaccuugucccccagagucaggggcugggagucauuuucucuggcugagugucagagguucaccacauuucugcuacacacucccugauggcuguuuacuuggacugacaguuaauguuggucagcaagaugaccacagugguuuagucucaauggugucacucuuccaguagcauaugguccugauuucuaauuuagauacgaacucaaacacauaugaaauuucuuauuuuccauuccaucuuccauuauauagcuaccuaucucgugcuauugaacaucacauaaggaugaccauguugacccacuggcucauguggauucccucuuagcuucugaguccccucaggaaaaugugcaguccugugcugagggggccagcucugccugcaggucacuagugccaugacaguuaaaguguucauacagacacauaguucauuguaauuacugauuuagcguugucuuggcaguuuucaguuugcaugcauuuauuuauuuauuuauuuauuuauuuauuuauuuaaugcauggaaguacacuguugcuguacugaugguuguuugccuuugugugguuguugggaauugaauuuuuuuuuuuaggaccucucuuugcucuggucgacccugcucacuccggucaacuccuaugggucaacucugcucauucagucccugcuuguucuggcccaaagauuuauuuauuauuuauuauacauaaauacacuguagcugacuucagaugcaccagaagagggcgucagaucucauuacagaugguugugagccaccaugugguugcuggaguuugaacucaggaccuucaaaagagcagucagugcucuuacccucugagccaucuccccaguccucaguuugucuucuuaauugugcgauuucuugaaucuuccaaacagaucccccaaagacacaugugacccaucaccccauaucuuaugaugcugucacccugaggugcugggcccugggcuucuacccuguugacaucacccugacuuggcaguugaauggggaggagcugacccaggacacggagcuuguggagaccaggccugcaggggauggaaccuuccagaagugggcagcugugauggugccuuuuggggaggagcagaauuacacaugccaugugcaccaugaggggcugccugagccccucacccugagaugggguaaggagggugugggugcagagcuguggucagggaaagcuggagcauucugcagacucugagcuggucagggcugagagcugggaucaugacccucaccuucauuuccuguaccuguccuucccagagccuccuccauacacugucuccaacauggcgaccauugcuauugugguugaccuuggagcuguggccaucauuggagcugugguggcuuuugugaugaauaggaggugaaacacagguaggaaagggcagggucugaguucucucucagucuccuuuagaagugugcucuaaucauuaaugggaaacccaucuacaccccacauugcuaccuucuccaacuggguccucugucaguucugggaacuuccaagaucuuccuugaacucucacagcuuuccuucucacagguggacaaggaggggacugugcuccagcuccagguuaguguggggacaggauuguccuguggacauugcagugaagcuggagauguuggggagcucugggaacccauaguaacucuuccagagaaaucuuccagggccgcaguuguccaauaugaauacauauauguacauaugcauauacauuuuuuacccuuggcagggacagcuccuagagcucugauagaucucucccaggugguaaaggugacacucugggaccugauuggggaggggcaauguggauaugauuggguuucagggacuccacgaauccccucugagugagugguggguuguuggaauguugucuucacagugaugggucgugucccuc

SEQ ID NO: 100 - RNA, 211 nt, Homo sapiens
uuaaaucuggagggauuuuucacacagccuaucuuuuuaggugugccuuucccauauuuuauuaaacucgaguuguuguuuuaaaaaaacagcagcauuaucaaagacacaucuguacaaacauuuuacaaaagagaacucucuaggaucagcuacaucaaggacaagcagaaaaauagaugcaguccaacaaagacauugaaaaugacuu

SEQ ID NO: 101 - RNA, 8252 nt, Homo sapiens
ggucgcuuucugucuguagaggcggcuugccacccgagcagagggucgugaaguuccgaccggaccgguccacagagguucaucuggagagguggguccccuccgaggugaaaggcgccgcugagaaacgcccccaccccccgugguucaagugguucagcccaagaacuuuucauucauaaaaaagaccagacuccgagaggcgcgagugagucagaaccgcagccgccaacgcggacccuaccgaacauccagcccagggcauguaccgagacuacggggaaccgggaccgagcuccggggcuggcagcccguacggucgccccgcgcagcccccgcaagcucaggcacagaccgcccagcagcaggugagacuggccgaaucgucggggggggggggaccugaguuuggacagcaucagggaugcugggauuagucuaguuugcuccgggauuuggacuggggccccgagcagcaucugacucugguggucgcgaccgaggauccugcacguucuguguggucggggaaccuauguacccgguggccaaggggacgagcgcagcgggaagcgcgaauaucugcgaauuccccuucucgcucgcccguaucucccuagcugacugucuuucugccccuccgucuccguuacggucuuacauuuccuccuaucugccccuaauacgcugucccucuaaauaccugccccaucccugccuggacaggaucagagguguucuccaucuccaguuaauaacugggaccuggggucugggcacauagagacgggguccaucagaacucagccgggacagagaauucuuagcagccuguccgaggcuguccguguguugcucugguuguccgugucccuuuauccggucaaguccucaucucuuugugcgcaguauagagcccaugggccccaggcagugguuccgagggguuccuggagaccacgaaguguugggaugugcgcggggucaccugcccggccacacucgcgcuccacauucucggcacccgacgucucucacugcuggauaggggcacuugagagguugcagguguccauuuccugucgaggggccgcgagcacgugucgccaggggagggaaggagcugcguccguuucgccgagucacagcgggccgagucacugaggcugagucacccugggugccccucccuuccuggccccaaacggccccuaaggaccgacgaccugggagcgagagaugccccuggcagugcuucuagcccagaacgggggucacugagaugcugggucccccaguauugggcuggggacauagcuguccagacuugccuaagcaugugaggugcuuccuggacuggagggcccccacauccuuagcucacagagcuugaacccaguuuucucucccagaacgcugagcccccacccccaccgacacucaaucccaacacaugccucagauuucugcaagaaaaggaaggaaaggaugccagaccccuuauaggaggcuuuuacucucuucacuuuauuucauggacuuaaaaaaccccaucaauuuugaacuuucaaguuuuuaagucgacagcuaggcaugcauuuaaucccagcauucaggaggcagaggcaggcagaucucugggaguuugaagccaauuuggucuacaaagugacuuccaggucagcuagagcuacauaauagagauccugucucaaaacuuaaaaaauaaaaaacaaaaacaaaagccgauuaaaacucugauuucugagcuaugagagcuggcuucucaacagcaauggaacguugaaugauguuaauaacagggaaacugagacuaaauaacaugccccagucucaaagcccaucaauggccaagcuccaagcugaugcuggacucccaagcucuggugcuacaugucuauagucuuggugccugggagguagaggcagaggaaucgugaguuuaggucuagccugagcuaugugagauccugcccaccccacccccggcccccaaacaacaaauucucauccugauucucagaauugccuugggagcuagaagcugaaaguaugcccaucugugaggacugggucucaaaucuuaguuucuacuuacuagcugugggucuaugggcaacugcucuccugucugaaaacaggauuauggcagcugugugagucacuauuuguuaaauaguuggaacaguguuacgcaguccauacuugauuuaaaacaaaaaaccaaacuaucucugguggggaaacagacagacgaagagagacauuuugugaccugcccaaaaucacacagcuccugaacaaguaaguuucugguugccaaauguugcuccuuguggucucccaaaacugguaucuacacugaggugaagggagacagaaguccagccucuguccccgggaagccccucaguccacacagaccuuaucauuucccuucuuaucucucagaaguuccaccuugugccaagcaucgacagcagcagccaggaacugcacuggauggugcagccucauuuccugggacccacuggcuauccccgaccucuggccuauccccaguacagucccccucagccccggccaggagucauacgagcccuagggccaccuccgggggugcgucgcaggcccugcgagcagguaagaaacagcgauguuucacuuuccauagcccguagggguccuacuagacagggacaggaucuugcuacgagggaauuucuuauucagcauugaaguuccugagaggccaagaaggagguaaaaggucaccuuugagucaaggaaggcuuccuggagaaggcuacacguuaaccuaaaccacggauaggauuugcguauggaagcugaaaagaaucuucugggaggaggguuggaggcacagaauugaggugaaggggacagaguguuaagugagcaugucuccacugucugacgugcacaggguggaaggaagccugaugcuggcuuuguaccucggggugacucuucuuuucaacagucacggaaucucagccuauuucuuuuaauuaucacaaaaagugagugggcagugguggcucacaccuuaaauuucagcacuggggaggcagaggcagguggaucucuggguucaaggccagccugguuuacagagugaguuccaggacagccaaggcuacagagaaacccugucucaagaaagggaaaaaaaaagugaaugggaaauguauuucaauuuuuccaucuuccaucagaggaagugaagcauagagggguacucacuuguccagauucauacaaaugugaguaaugagacaggacugguccuggccugaggucuacucaacucccaaagucagagcuuaaugagccacugucucaaugggagcucacagaagccugcagagggagugagcugagaacuuuugccucccugaaugccuuucuaaaauaaagaaggguguguuuugguugguuuguagagguggggucuugagagccuccugccuucccaagugcuaggaguauagguguaugcuagauacccgacagggaugacggaucuuuuaggccauagcacuuucuuuccucucccugaaguacugagacugagucuagugcagggaggccuccauacuaaaaagcuggguguacccguaaucccagaacucggaaaaucaagacaggaggagccauucaagucacgcucagaaacauggagaguuuaaggucagccugggauauauaaacccuaucuccgauaaccaaacaacaaucaaagcaaaccugacuuaaguguuaaguaggaaagaauaugcuguaagucaucagccuggcugggggacugaccgccucugagggacugaagaaccugcuucaagcccggagcccugcacucaaccccuaguggaugcacacacagauccuugccaugauggcucgaagagggauggcaagacccugggagauaugugagauuggccagagaagagccagcaacaggcuucccagcaagggaacagcuuaccucugugaucagcuggggcgugagcaagaggcaagcccagggugaauccuuccuuuagcccuguccugaggagacaccuuuugaccacggguacuaguggguuggagcugugagcuguggguagguggcuuccccucggugugcucuggaacuugaacaaaucacucauccuuccugagcuuccucacaugugagugugcagagaucuggaugggugacucagcagcggcucuggcugcuccuuagaggauccggguuccaaucucagcacccacguggcaacucacuguccacaacgucccccaaagguucugaugcccucuucuggccuccaccagcacugaaugcacaaggugcucauacaaacacacaggcaaaauacucagagguaaauuuguucuuuuuuuucuuuugagacaggguuucucuguauagcccuggcuguccuagaacucacucuacagaccaggcuggccucaaacucacagaggcaucugccugccucccaaguguugggaccaaagauguaugccaucacuauaagccuuuuuuuuuuuuguaaauuuuauuuaugaaugagugcuuccauguauaccuucaugccaggagagggcaucagauccuauuauaggugguugugagccaccguguguggcugggauuugaacucaggaccucugaaagaggagcucuuaacugcuaaaacaucucucuagccccagucuacauauuuuaaaucuuuuuuuaagauugauuuauuuauuauacauaaguacauuguagcugucuucagacacuccagaagagggcgucagaucuuguuauggaugauugugagccaccaugugguugcugggauuugaacucaggaccuuuggaagaguagucaaugcucuuacccgcugagccaucucaccagccccuuuuuuaaucuuuaaaaaaaaaagggggggggccuggagagauggcucagccguuaagagcacugaaugcuuuuccagagguccugaguucaauucccaacaaccacaugguagcucacaaccaucuguaaugggauccaaugcccucuucugguguaucugaagacagcaagggucuacucacauauguuaaauaaauaaauaaaaauuuaaaagccaggugguguugguucagacagcagaucucuguuuaaggccagccuggucugaucuacaaaccaaguuccaggacagccagggcuacacagagaaacccucuaaaaaaccaaucuauguagggggugcuggugaaauggcuccguggguaaagguacuugcugcgaaauuaaugaccugaguucaauccuugaaauccacacaguagaaggagagaaccaaccuccaagggugcuaugacacacacacacacacacacacacacacacacacacacacacacacacacacgacuauauauaugaauauaugacucuagccaggcauaguguggcacaugccuuuaaucacaguacuugggaggcagaggcaggugaaguuugaggccagccuacagagugaauuccaugacagcuagaacuaugaagaugaacccugucuuuaaaaacaacagcaacauaaagaaucuauguagggaagcuggaagggaugcugauacagucugcaauccuauuacucuagagguggaagccaaagaaucagggguuucaggccggucuugccuauacacugagcuaaaggccagccugggacacaugagacuuugucucuuuuaaaaagacaaaacaaggggguugguuagauggcucaguggguaagagcacccaacugcucuucugcagguccgaaguucaaaucccagcaaccacaugguggcucacaaccaucuguaacgaaaucugagucccucuucuggagugucugaaaacaacuacaguguacuuacauauaauaaaaauaaauaaaucuuaaaaaaaaaaaaaaaagacaaaacaagccagaugaggucugugaguuccaggccagccuggucuauaaaucaaguucaaggccaggcagggcuacucagagauucugucuaaaauacaaagaaacaaaacuacaaaaagcagaaaaaggaaucuacgaaagggcuggugaagggguguaacucagugguagagcauuugccgagcuagcauguaccaagccauggguuugaucccuagcacuaagcaaaagaaaaguccuacaaagggcuuuguuggcauaguagauugauucccaguagcuuuuggcacucaagagcaccuucuacaauucacagcuccugggggaagaaaucccaucuuccacagaugaggaggcugagaguccugugaaaagagauaaucaugucucauacacucaggagagaaggcuacuucugccugagaaaugaaaaggcuuccuggggucccaacaucuuaguccaguccuaagaugcggaagggaggaagaucaaaguuuacagagagggaaagcauuucaggaaagaaaccagcaguaaagcuaggugugugugagcuggaaaugucaccaaugagaugacaagcguccgguacagagaagcaacuguggaguguugggugguggcaccuagacuacagacugaaggaaagcuggaugaccagcucagggcagcugguggcucagagucagccucauugucucccuucuucuaucccaaccuagaucagcccagaggaggaagagcgccgcagggugagacgcgagcggaacaagcuagcagcugcuaagugcagaaaccgaagaaaggagcugacagacuuccugcaggcggugagcaucauccccaggcccggacccacagagccccaagaggggucucggcucccaagaacacaaaagacccaaaauuacuccucaggacucugucauccucccugccuguggggaaguccuggaaaaaggauaagggaaaguggcuuaaauauuguuugucgggcuucgaggcagagucgaagaugguaggcagcaauucuccuaagaugcccccgucugaugggagucauggccauuuucucccagaggcucacgggagggaguugcaguccagacuuguuggggaugacaggcacagucccuacuccagccugaggcuuggggaucuuuagccuucauuuuccuaucuuucugcuaauccuguaaaggagaccgacaaauuggaggaugagaaaucggggcugcagcgagagauugaagagcugcagaagcagaaggaacgccuugagcuggugcuggaagcccaucgccccaucugcaaaaucccagaaggagacaagaaggacccaggugguucuggcagcaccagcggugcuagcagcccaccagcccccggccgcccagugccuugcaucucccuuucuccaggacccguacuugaaccggaagcacugcauacccccacgcucaugaccacacccucucugacuccuuuuacuccgagucugguuuucaccuauccuagcacaccagaaccuugcuccuccgcucaccgaaagaguagcagcagcaguggcgaccccuccuccgacccccugggcucuccuacacuccuggcuuugugaggcacccagccacaucccuugcuggugcuacuccaagccauccccuuucucccauugauccagcaggccuggaccauacccuugccccaaaccagcagaucuuuuaucucuuccgacuagaacaaacacauuaugcuuugauguagagccagcuuggaggggauccccaaagcugcucacuguuuuucuagagcuggccuaucauaauuugcacaaaauuagaggaaaauauguucccucugccagagaacgccuggcagcccagacuuuguagauccccagggguccuuugacacccuuaccccuugcagaccacuuucccacaccacgucacuuucuucauguuauccagccuacucuacaccuagacagaaggugcccuuugacuagccuagaacacuaacucacacagcaucaacagccagcagcaccggacauccugcaggcuccuccugaauggcacaacgcaggaggcgccaggggcuucugugaggagcggagcugcacucccuagcucugagaagcgcuuagcuucaggguauccgagccuccaccgcaagggcagcugcuauuuauuuuccuaaagagacuauuuuuauacaaaccuuccaaaauggaauaaaaggcuug

SEQ ID NO: 102 - RNA, 1938 nt, Homo sapiens
ccguggguuccuaauggugcuauugacgacgggcacaaagucucauaauuuuagaaacuucacuuauuuugugacccaccuaguauggggcaaaggcaggagcuucggacuuccugucuucccucuaucccuuugaauagcgucucgggagugucccuaaguaaccauugcaguuuuguguccgugugcucuguugaaaucucugugauguguguaugguuuucacgugaacggaggcaggcagagcccggucuguggguucuaguguguucuuuaucuucuuggaaguuugugcaaugacuucccuccuguuuccugcgcauaccuccaaguaaguacgugaauguguuuucuguggucccuugaucuugcuggacuucacuaaggaggguggcuggaccaucugcuacgugucugagagccccucucuagcuaccucauguccggacgugagcuuacucccaauguuuuuacccacaagcauucacuacucccaggaaagaacgugcacuggggcaccuagagaauaaccaaucaacgcuccgccuacauuuugcuuccuccuuggaauuuccagccccuugcagccaacugcuccccagcugcgaagggcggaguuccccccggcccggccccuucuuuggcucuauaaguagcucugcuuugcgggggauuugcacuccucuacacucucugcacaacgucuaaauuaugugccacucgcgcaaccaucuccacaccaugacuggccugagggccccuucuccagcucccuccaccggcccggaacuccggcggggcucuggucccgaaauuuucaccuucgacccucucccggagcgggccgugguguccaccgcgcguuugaacacuucucgcgggcaccgaaaacgcagccgaagggugcucuacccucgaguggugaguaucgcccgagugggcaucaggaggucgcgucgcccuggaacuuguagguaacaacuaggagcagggaccuucgaucugacguuucccucuuuuaucugcucagguccggcgccagcuaccaaccgaggaacccaacauugccaagaggguccucuuucuccuguucgccaucaucuucugccagauuuugauggcugaagagggugugucgcagccccuggcuccggaggaugcuaccagcgccgugacaccugagcccauuucugcgcccauuacugcgcccccgguccucgagccuuugaaccugaccucggaguccucggacuaugcgcuggaucuuaaagcuuuucucuagcaacauccggcggccuucuaaacgcgaugggucacaguccgaagaaacaaaggcaccauggauggguaccuggugcgagagaacguaucccaaacugggauuucuaaggcaacgcuaacucagaacacuaccgccaagagacaccgcggguccuggcuaggcccacuggggacggacagagacuuucuccgugucuaauuaauauuuauguauuuauguauauccuccuaggugaaggagggguguauguaauauuuauucuaacuuaugcaggggugcgagauaugccucccugcuguaacacagauauuuauuacgauuuauagggucgguaagacagaguugugggagggaggacccgggugguaggacucccagcuuggggauuagucugggggggguguaauaagauuagggguaacacuccgucuuccagcacuucaacucuguagucuguuguaaggcuuuggaagacccuugggaauccggccuuugaugucuucugguugcuucucaggggcagcugcaggagucuuggguccauggauugucagagggcggcugucuggggucgccuaguauguauguucugugaacacgaauaaacuugauuugccugucauuauuaucugcaguucucgaaguguaucauucag

SEQ ID NO: 103 - RNA, 3036 nt, Homo sapiens; identical to SEQ ID NO: 65

SEQ ID NO: 104 - RNA, 279 nt, Homo sapiens
uuuuuuuuuuuuuuuuuaaauugccgaauuaaguucuuuuaauagauugcauauauagauguuuagccauacucuagaucaacucuuuaagaguagaauuuuauauccaauuuacaugcuucagauaucaccucuguuuguuacauaaggucuuguauccaaauguccacuuguacacugagagcuuuaggaacaaaaaaggacacagagagaguugccauuuuuagcagcaaugaaacaucacuaaccccuuuuuacauaccgaauucaagucacuac

SEQ ID NO: 105 - RNA, 143 nt, Homo sapiens
cggccgccgguauuuuuuugcaaguauugagaguucuguauguuuugaaaagaguaauuuuaacguuugggugccaagaaguggguuuucucagaguccauugccggcaaugggcaagccuggcgguacuccucgugccgaau

SEQ ID NO: 106 - RNA, 989 nt, Homo sapiens
auggcgcugggaacgcugcuccugcugcuggcggccgcccuggcccggacccagaaccgagccggugagugcagggucgggagggaaacagaacuuuccaaacagucugcggggaggggcgggugcggcaccggggaagccgcgugcccgcgucgcccaccagacccuccgucucuuuacccgcgucccuagccccgcgcccugcuccccuccugucccgcgcauccgcccggggucccgggagaaggucggggucucaccgcgcgccgcccccaggcucacacucgaugcgguauuucgagaccgucgugucccggccgggccucggggagccccgguacgucucugucggcuacguggacgacacggaguucgugcgcuucgacagcgacgcggagaaaccgagguaugagccgcgggcgcgguggauggagcaggaggggccggaguauugggagcggaucacgcagaucgccaagggccaugagcagugguuccgagugagccugaggaaacugcuaggcuacuacaaccagagcgcgggcggugagugaccccgggucggaggucaggccccuccacuucccgacacagggacgcugacguccugguucccaagucugagguucgggaacagaacggacccgggaccgguuucccuuucaguuuggaggaguccgcgggugggcggggcugaccgcggggucccgcagguucucacacacuccaggagauguauggcugugaugugggaucggacgggcgccuccuccgcggguaccggcaguccgccuaugauggcugcgauuacauugcccugaacgaagaccugaaaaccuggacugcgaaggauguggcagcgcugaucaccagacgcaagugggagcaggauggugcugcagaguauuacaaggcuuacauggagggcgagugcgugcagucgcuccgcagauaccuggagcucgggaaggagacgcugcugcgcacag

SEQ ID NO: 107 - RNA, 4484 nt, Homo sapiens
auggcgucaacaaugcugcuucugcugguggcagucgcccagacccugaucgagauccgcgcgggugaguaccggguccggagggaaauggccucugaggaaaggggagggggcggcacgggggaagccgcgucccggcgucgcccaccugacccuccgccccuucuccacccuagccccgcgcccugcuccccucccggcccgcucacccgcgggggucccggaaggaguucggggucucaccgcgcccugccuccaggcccacacuugcugaguuauuucuacaccuccgugucccggccgggccuuggggagccccgguucaucucugucgguuacguggacaacacggaguucgugcgcuucgacagcgacgcggagaauccgagauaugagccgcgggcaccguggauggagcaggaggggccggaguauugggagcgggaaacacagaaagccaagggcaaugagcagauuuuccgagugaaccugaggacccugcucagcuacuacaaccagagcgcgggcggugagugaccccggaucggaggucacgaccccuccacgucccaaaacaggggcccgagacgucccgggccccaaguucgagguucugagcagaacggacgcgggacugguuucccuuucaguuuggaggagccgcgggugggcggggccggggcgugugggcggggcugaccgcggggucccgcaggcucucacacuauucaggugaucucuggcugugaagugggguccgacgggcgccuccuccgcggguaccagcaguucgccuacgacggccgcgauuacaucgcccugaacgaagaccugaaaacguggacggcggcggacauggcggcacagaucacccgacgcaagugggagcaggcuggugcuacagagaaaagcaaggccuaccuggagggcgcgugcgugcagucccuccgcagauaccuggagcucgggaaggagacgcugcugcgcacaggugcaggggccgcgggcagcuccucccucugcccucgggcuggggcucaguccuggggaagaagaaacccucagcuggggugaugccccugucucagagggagagagugacccuggucuccugaucccucaucacagugacugcacugacucucccagggcucagccuucucccuggacagugcccaggcugucucaggagggaaggagagaauuucccugagguaacaacagcugcucccuucaguuccccuguagccucugucagccauggccucucccaggccggguucucagcccacugucuguagacacugacuccuguccugcugagugugucagcccuuacaccucaggaccagaagucgccuuuaacugaucggagacauggacuacccuacacuaggcugauugccucaguuuccugaauuuucaaaagaauacauucucccagaucccucccugucugugggguuuccaccccuucgacaaccuaauucucucuauuccuauagugguggucacaucagcccuuaugggguacccuggaggaauaucaauaguggaauuucuucuucuucuucuucuucuucuucuucuucuucuucuucuucuucuucuucuucuucuucuucuucuucuucuucuucuucuucuucuuccuucucucucucucucucucucucucucucucucucucucucucucucucucucucucucucucucuucuucaguuuuugagauaggguuucucuguaugcccuggcuguccuggaacucacuuguagaccaggauggccucgaccucagaaauccgccugccucugccucccagugcugggauuaaaggcguguggccaccuugcccagccuuucuuauuuucuuuacuuuuuuuuuuuuuuuuggaggggguaauuuuguuucuagucaucuuuugucuuuugucugcacuggagugauccuguuucucccugcccuuauauuaucauguguaucagucuccacaggugccagggaaguuaagacaaguuaaaucaggguucucuuuaaaggagagauuccugugaacuuagacuguuuccugucagaacuaaacauccagaagccuccugcucuuccucugucccacaaguuacagugcuccccccccccccccagugaaucuggacuuggacucugagagacagggucuucugcaauccagggcuggagugagagggaagaccacacacccugugagcccacuguguugcagugagugcugcacugggguccacagcauacuccagggauccugugugacacaccuguaccuugucccccagagucaggggcuggaagucauuuucucuggcugagugucagagguugacaccauuucugcuacacacucugugauggcugcucacuuggacuggcgguuaugcuaguuagcaagaugaacacagugguuuacgucucaguugucacacccuuccaguggcauauggcucuaauuucuacuuuugauacgaacucaaacacuuauuaaauuaguuaguuuccauuccaucuuccauucuaguccauucaugcuaaagaacaucacauaaggacugccaggaugacccacuggcucauguggauucccucuuagcuucugagucccccagaaaaaugugcagcugaggaaaccagcucugccugcaggucaccagugccaugacaguugaagugucaaacagacacauuguucagugucaucagugauuuaacugugccuuguguagauuucagagggucuuguuaauugugguacuuuuuuuuguuuuuuguuuuuuuuuuuuuuuguuuuguuuucaagacaggauuuuucuguauagcccuggcuguccuggaacucacauuguggaccaggcugaccacgaacucagaaaucugccugccucugccucccgagugcugggauuaaaggcgugugccaccaccaaccagcuaaucgugagauuucuuucuuuuuucuuuucuuuucuucuuuuuuuuuuuuuuuuuguuguuguuguuuuguuuuuugagacaggguucucuguguaucccuggcuguccuugaacucacuuuguagaccaggcuggccuugaacuuagaaauuugccugccucugcuccggagugcugggauuaaaggcaugugccacuaccaaccagcuaauugugggauuucuuaaaucuuccacacagauccuccaaaggcacaugugacaugucaccacagaucugacggugaugucacccugaggugcugggcccugggcuucuacccugcuaacaucauccugaccuggcaguugaauggggaggagcugacccaggacauggagcuuguggagaccaggccuucaggggauggaaccuuccagaagugggcaucugugguggugccucuugggaaggagcagaauuacacaugccaugugcaccaugaggggcugccugagccccucacccugagaugggguaaggagggugugggugcagagcuggggucagggaaagcuggagccuuuugcagacccugagcugcucagggcugagagcuggggucaugaccucaccuucauuuccuguaccuguccuucccagagccuccuccauccacugucuccaacauggcgaacguagcuguucugguuguccuuggagcuuggccaucauugcagcugugguggcuuuugugaugaagagaaggagacacacagguaggaaagggcagagucugaguuuucucucagccuccuuuagagugugcucugcucaucaauggggaacacaggcacaccccacauugcuacugucuguaacugugucugcucucaguucugggaacuuccuagugucaagcucuuccuugaacucucacagcuuuccuucucacagguggacaaggaggggacuaugcucuggcuccagguuagugugggggacagaguuguccugaggucauuggagugaagcuggaguuguugggugcucugggaacccauaauagcuucucuguuguaauccucugguggccugugucagaucuugcuauagauauaucuuuguauauauuuuucccuaggcagggacagcucccagagcucugauauguuucucucaagauuguaaaggugacauucuauggccugauugcagaggggcacuguggacaugguuguguuucagggacucccacaauccccugugagugguggguuguugggauauugucuucauuguggugguuccugacccucauucucuaucaugaagacagcugccuggaguggacuuagugacagccagugugaccuugggucuucauuuuucuuuagagaacagcgccugauguucccugugagccuaugggcucaaugugaagaauuguggagcccagccuucgccuacacaccaggaccugucucuugcauugcccuguguucccuuccaccgccaaccuuccgggucugcag

SEQ ID NO: 108 - RNA, 385 nt, Homo sapiens
uuuuuuuuuuuuuuuuucagaauaauugcagacaaauuccauuuauuuuucuaaaaaccucauuaucuaaaauuuauacagccucacauuccuaaaccaccucuggcacuuuucuugaauuaagucaaggcguacacagcuccgaaagaaaaauagagauccgguuccaggaagauggccaugaggacucgcagauaugucuccucggaccuggaagcgugucagccaugggauccacuaauccaccauccgguacacagggucacccacucucaggcucccaagcuucuccaccgagaaauacaucccaaaaaguggagaugacugguauauacucuucacagaaggaucacacaggcgauagcucuucagggucuccaguggc

SEQ ID NO: 109 - RNA, 2247 nt, Homo sapiens
cucuagaugaauacacucucaugagggccaccuucucugguaguucaggucgccucugcccauccuucccugcguccucucccaaaguggccuacaacccuuacccagaggacuauggagacauugagauugguucucacaagaguuccagcaguaaccugggggcagaugauggcuacaugcccaugaccccuggggcagcccuuaggagugguggucccaauagcugcaagagcgaugacuacaugcccaugagccccacaagcgugucugcucccaagcagauccugcagccacgcuuggcagcggccuugcccccuuccggagcagccgugccagcacccccuucaggggugggcaggaccuucccaguaaacggagguggcuacaaagccagcuccccagcggagagcuccccagaagacaguggguacaugcgaaugugguguggcuccaagcugucuauggagaacccagacccuaagcuacuccccaacggggacuaccucaacaugucccccagcgaggcaggcacugcagggaccccaccugacuucucagcagcuuugcguggaggcagugaaggccucaaaggcaucccgggccacugcuacagcucuuugccccgcucuuauaaggcucccuguuccugcagcggagacaaugaccaguaugugcucaugagcuccccugugggccggaucuuggaagaggagagacuggagccccaggccaccccaggggcuggcaccuuuggggcagcuggugguagucauacccagccucaucacucagcagugccuuccuccaugaggccgagugccaucgguggccgcccugagggcuuccugggccagcgaugucgggcagugcggccuacacgccuaucgcuagagggacugcagacccuucccagcaugcaagaguacccucuacccacagagcccaagagcccuggcgaguacaucaacauugacuuuggugaggcagguacccgucugucuccgccugcccccccacuacuggcauccgcggccucaucuucuucacugcucucagcuaguaguccugcuucaucccuggguucaggaaccccaggcaccagcagcgacagccggcagcgcucuccacucucugacuauaugaaccuggacuucaguucucccaagucccccaagccuagcacccgcaguggggacacaguaggcuccauggauggccuucucucuccagaggcuucauccccauacccaccacugcccccacguccuuccacuuccccuuccuccuuacagcagccucugccaccugccccgggagaccuauaccgccugccuccagcaucagcugccacuucccagggucccacugcuggcuccucaauguccuccgagccuggggauaauggugacuauaccgagauggccuuugguguggcugcaaccccgccacaaccuaucguggcaccuccaaagccagaaggugcccgaguggccagucccacaucgggcuugaagcggcuaagucucauggaucagguaucugggguggaggcuuuccuucaagucagccagcccccugacccccaccggggugcuaaggucauccgugcagacccacaggggggacgucgucgccacaguucagagaccuuuuccucuaccaccaccgucaccccaguguccccauccuuugcccacaauuccaagcgccacaauucggccucuguggaaaaugucucacucaggaaaagcagugaaggcagcaguacccugggaggaggugaugagccgcccacauccccaggacaggcacagcccuugguggcugugcccccagugccacaggcuaggccguggaaccccggucagcccggagcuuugauuggcuguccuggaggcagcaguucucccaugcgcagagagaccuccguggguuuccagaacggccucaacuauaucgccaucgaugugagaggcgagcagggguccuuggcgcagucucagccgcagccaggagacaagaacuccuggagccggacccguagccuuggggggcuccucggcaccgucggaggcucuggcgccagcggaguguguggggguccaggcacuggagcuuugcccucugccagcaccuaugcaagcaucgacuuccugucccaucacuugaaggaagccacagucgugaaaggugaggcccuuugaccuugaggaugggggagggagaguggaguauuggguggcu

SEQ ID NO: 110 - RNA, 315 nt, Homo sapiens
uuuuuuuuuuuuuuuuucagcugugaacuauuggauuugagacaggaacagaacaaaucgacgggccagaggaggguggagagagcacgagugguuuaaauaggggaggaugggagcauggcggugggggugggggaagaguuauuuacaagaaggcucagggggccagaggcucaucuuggaauauuuuauaacaauauauauaagauucugguuugcuuuuccuuuucgucucguaaaggagagagaauugcauaguucgauucuguccaagggggcagcugcauauggucggccgggcgggucacuggucgu

SEQ ID NO: 111 - RNA, 481 nt, Homo sapiens
uuuuuuuuuuuuuuuuuaagugucaccacuugugacagucagcauguuacuaucagcuccagccgcagcguuuuuaaggcguuauagauuaggcaggcaauacaaggaacacgauuaagaaacugacacguaccacacgagcaauuuccagaggcuccucuucugcggugcacacguaacagugcucuuguugacauucagacaguucugagggccacucugagaggcgccuuccuguucucaccugacaaggauauuguuugguuugguuugguuugguuuugccuuacuauggcuuuucuuucaacuacauuuugugucaugcuuguuagcuaacucaaauuuugucuuuguauauuuacuacuguaaaauuagaauaauuuacuguucaucucauccucugucacugauggaaccuagagacgccacaagagccacugccgugacauaccucacaagcuacaucccuguccucaaaau

SEQ ID NO: 112 - RNA, 379 nt, Homo sapiens
cggccgcggccaccggccugcgccaagcugcugcugcggcagccaguaccucggugaagcccauuuucagucgcgaccugaacgaggccaagcggagggugcgcgagcucuaccgcgcuugguaucgggagcgugccgaacaccgugcacuuaaugcagcuggauaucacggugaaacaaggacgggauaaaguccgagaaauguucaugaagaaugcccaugucacagaccccagagugguugaucugcuggucauuaagggaaagauggagcuccaggaaaccaucaaaguauggaagcagcggacacacguuaugcgguuuuuccaugaaacagaaacaccaaggccaaaggauuucuuauccaaguucuauaugg

SEQ ID NO: 113 - RNA, 3733 nt, Homo sapiens
gcaccugagcgcgggugccuggcgcgcccgaugggaucguugagaggcccucgacggaaagucccaaacucggaucgcauucagccaaagugaggcggcgccauggagcuccgagcgcugcugugcugggcuucccucgccacugcuuuagaagagacccuguugaacacaaaacuggaaacggcggaucugaaaugggugacuuacccucaggcagagggccagugggaggagcuaagcggccuggaugaggaacagcacagcguccgcaccuaugaggugugcgacaugaagcguccagggggccaggcucacuggcugcgcacuggcugggucccaaggcgaggugcuguccacguguaugccacgauacgcuucaccaugauggaaugccugucccugccgagggccagucgcuccugcaaggagacauucacugucuucuauuacgagagcgaacgugauacggccacggcccauacgcccgccuggauggagaaccccuacaucaagguggacacaguggccgcagaacaucugacucggaagcgcccuggagcugaagccacagggaaaguuaauaucaagacgcugcgccuggguccucucagcaaagcuggcuucuaccuggcuuuccaggaccaaggagccugcauggcucugcucucccugcaucucuuuuacaagaagugcuccuggcugaucacgaacuugaccuacuuccccgagacggugccucgggagcucguggugccgguggcagguagcugcguggccaacgcggucccuaccgccaaccccagccccagccucuacugccgggaagauggucaaugggcugagcagcaggucacgggcugcagcugcgcgccaggguacgaggcugcggaaagcaacaaaguaugcagagccuguggccagggaaccuucaagccccaaauaggagacgaguccugccugccgugcccagccaacagccacucgaauaacauugggucuccugucugccugugucgaauuggguauuaccgggcccgcucagacccccggaguucaccuugcacuaccccacccucugcuccaagaagcgugguucaccauuugaaugguuccacccugcgccuggaguggagugcuccccuugaguccggaaggccgagagaccucacuuaugcuguucgcugccgagagugccguccuggggguuccugcuugcccugugggggcgacaugaccuucgaccccgguccucgagaccugguugagcgcuggguggcaauccgagggcugcguccugaugucaccuauaccuuugagguugcugcuuugaauggugugucuaccuuagccacuggaccaccuccuuuugagccugucaaugucaccacugaccgugaggugccuccugcagugucugacauccgagugacucggucgucacccagcagcuugauccugucaugggcuauccccagagcacccaguggggccgugcuggacuacgaggucaaguaucaugagaagggcgcagagggccccagcaguguucguuuccugaagacaucagaaaaccgagcugagcuccgggggcugaagcggggagccagcuaucugguccagguacgcgcacgguccgaggcuggcuacggucccuucggccaggagcaucacagucagacucaacuggaugagagcgagagcuggcgggagcagcuggcccugauugcaggcacugcgguugugggugugguccugguccugguggucgucaucauugcaguucucugccucaggaagcagagcaaugggagggaaguugaguacucggauaagcaugggcaguaucucaucgggcacgguaccaaggucuacauugauccuuuuacuuacgaagacccuaaugaggcagugagggaauuugccaaagagaucgaugucuccuaugucaagauugaagagguaauuggugcaggugaguucggcgaggugugccggggucggcugaaggcaccagggaaaaaggagagcuguguggccaucaagacucugaaggguggcuacaccgagcgccagagggcugaguuccugagcgaggccuccaucaugggccaguucgagcaucccaacaucauccgccucgagggcguggucaccaacagugugccgguuaugauccucacggaauucauggagaacggagcccuggacuccuuccugcggcugaacgacgggcaguucacagucauccagcuggugggcaugcugaggggcaucgccucgggcaugcgguaccuggcugaaaugagcuauguccaccgagaccuggcugcucggaacaucuuggucaacaguaaccuggucugcaagguguccgacuuuggccucuccagauucuuggaggagaacuccucugaucccaccuacacaaguucccugggaggcaagauucccauccgauggaccgccccugaagccauugccuucaggaaguucaccucugccagugaugccuggcgcuaugggaucgucaugugggaggucaugucuuuuggggaacggccauacugggacaugagcaaccaggaugugaucaaugccauugaacaggacuaccggcugccuccuccuccagacugccccaccucccuccaccagcucaugcuggacuguuggcagaaggaccggaaugcccggccccgcuuuccccagguggucagcgcucuggacaagaugauccggaaucccgcuagccucaaaaucguggccagggagaauggcggggccucacauccacucuuggaccaacggcagccucacuacucugcuuucgguucuguggucgaguggcuucgagccaucaagaugggaagauacgaggaaaguuuugcagcggcuggauucggcuccuuugagauggucagucagaucucugccgaggaccuucuccgaauuggagucacucuggcaggacaccagaagaaaaucuuggccagugugcagcauaugaagugggaagcuaagccaggagccccuggugggacagggggaccagcccagcaguucugaccuccaaggacucaccaccguggcagauucuucuuuccgggaggcagaguuggguggggacucacaagaugagccccucccccucgucacagccuucccauuggauugcacuuugaacagagggggucggagacacagauuuggggaaccgugccauaugggaucauacaugugcccuccaggcggggaaccccaaacucagagugagucuuucccucaagacugggcaaagaaacaucccuacgucucuaaccucccaucuucccagaggcucucuccccaagcgccuuccaccucaacgggcaugucccugcagaccaaagagaaagggugaccagccugccaacuugggaguggaaaaugccgucccaggaggcaggaaggggcugucaggacccggugauguaaucauuggguuuugauguccugacuugcugucaccaccaaaggcaaucauuuuucccuuguaaaugccccuccccucaucugccuucauauugaagguucugaaguuuuacuguuuuuuauuuuguuaauuuuuuccuccuuccccccucccuccccuucuuguccagauuuuguguguuaaagggcaccugguuccacuaucuccuguugggaacaaggacccaucgauauguucuagaacagugccuuggaaaugcca

SEQ ID NO: 114 - RNA, 560 nt, Homo sapiens
  misc_feature (107)..(107): n is a, c, g, or u
ggcagcgagacgagcucacggucgaggauacgggugaagcgggacaggagcaggagccggagccgggccaaagcagaaggugcaggucggcgccggcgguugggcangacccagucaagccggacagugaggagcggaugcagacggcacgaccauggccacgauggugcuuccucgagaggagaagcugagucaggacgagauagugcugggcaccaaggcggugauccaggguuuagagacccugagaggggagcaucgugcccugcuagcuccccuagcuucucaugaagcaggcgaggcugagcgggcucacaggagcgcugccuccuccugcgccgcucccuggaggccaucgagcuggggcuuggggaggcucaggugauccuggcauuaucaagccaucugggggcuguggagucagagaagcagaagcugcgggcucaggugcggcccugguacaagagaacagugguugcgugaggagcuggcagggacacagcagaagcucagcgcagugaacaggcgguggcucagcuggagaagagagcagcacaucu

SEQ ID NO: 115 - RNA, 560 nt, Homo sapiens; identical to SEQ ID NO: 114
  misc_feature (107)..(107): n is a, c, g, or u

SEQ ID NO: 116 - RNA, 1649 nt, Homo sapiens
augauguguggcgcgccaucugccacaaugccagccacggccgagacgcaggaggucgccgaccaggugaggcugggcccaggucaggccagucugagccaggccugcggagacccggcggccucagggaccggccugcccagacuggucagguccugcagcggguuuccggggcggccacaagugugacugggagcugggggcucuggaucugguuggaagauucagggccgggaacuggggcgagucuucugccgcuugcauacaagagggccacucaccuauuagggaacuagccccgggaucgguggagggauccgguggucccagagaauucaggaaggcaguguuagaaccuagacggcaccuuuuugacuuacacccaggccuaaacaagagaaagccagacugggcuacugugcuugucuccucaaaagaaagagcuaggacuguuuagcucaguggcaggaauucaacugauaccaccaccaccaucaccaacaccgccccucagggaaaaaaaaaaggaucaaaaccagaaguuguagaacuugcuugugccuagucugaaacgaggggguggaccuugggccugggcugcccuuccugugacuguuagcagagcagagauucaguacaagguagggggagguucaggguauuagcaagagaagaaaaguuaaacaaauccucucuucagcucuccugccacgccccaagcccaggacccuguccacuaagccuagcugaucuugggagguguuugcucugaacugaaguggccaagaaggaagugagucagcuccaugagacccuagaaaugaggaaauguuacagacacacuggccaggcaagggaaccuuggccacgugccacaucagcacucaggaggcagagacaggcgagucucucugaauuugaagccagcccaguuugcuuaguuccaugccagccauagcuacauagugagacccugucccccccccccccaaaaaaaaggagcuguguuguucuuuaucaguggggccaacaguuuaccaugucccccggaaugaggaguauugaaggcuggcagugugugugugugggggcaccugugcaugaaucuaaguccuuccuucucacccaccauccaggugaagucccagcuugaaucgaaagaaaaucagaaguuugaugucuuuaaagccauauccuucaagagacagauaguggcuggcaccaaccucuucaucaagguggguacugauaguagcuugccaugaacuggggacauagucucagaguagagcagaguguccugcaacuuccugcagagaaccccuuaaggggacauguacauguucugagaggaugaauuugggguguuaggguucccggccuuaaaggaggagacaaggguuaucacuggcuaaguuaguggcugguggccuguucuggcucaguuucuaaggcuggguuaagccuggaacuggaaccuuaccuuucacucacaugucugucugucugucuuccuccagguugauguugguggagauaaaugcgugcacuugaggguguuucaaccccucccccaugaaaacaagccuuugacccugucuuccuaucagaccaacaaagaaaggcacgaugagcucuccuacuucuga

SEQ ID NO: 117 - RNA, 334 nt, Homo sapiens
gaaaauguuaagagccaucaaauuucuggauauuuugcuaggaaaaugaaauucuacacuuauuuuuuguagacuuuuuuuaaaugcuguuuacaugaauuguauuuuggaaaaaauauuauacugugcacccugugaugcaugaagugauuuuauguauggucugcuaugugggcagaggucaccuuauuccuaugaucuggaauuguuuacuuucuacaaaguaagcuuuguggggauuuugcuuucauuuucuuuguagcugauguuauuuuaccaggugugcagcaggaauuacaccacuguguggaauuauaaauacaucccaugugca

SEQ ID NO: 118 - RNA, 481 nt, Homo sapiens
uuuuuuuuuuuuuuuuuccuggugaauauuuuuauuagaggugacaguuucccaggugacaguuuuucccaaggaagcaaaucucugcgucuauaagggaagaccacagaaccuucacuuuguaauuuaccuguguaauuuauccaagaacacagcacagcaauugcuuuaugugguacucugaccuuaaguaacaaguuguuaacagaaaacacaucaaacaaaaggauaauucucuaauuaucaagucagccaucagcuuuucuuaggagagagagagagagugugugugugugugugugugugugugugugugugucugucugucugucugucuggguaucccacuuagggccaugugcauguuagguaaaugcuccaccacugagcuguuucuuagccgcacuuuucucagauuucagguuuguuuguuuguuuguuuguuuuuuaacuaggcaugaaaauaaacuucacuucaaau

SEQ ID NO: 119 - RNA, 481 nt, Homo sapiens; identical to SEQ ID NO: 118

SEQ ID NO: 120 - RNA, 302 nt, Homo sapiens
uuuuuuuuuuuuuuuuuguggaaauuacucuuuauugaaaaauaccaguaauacugacagacuucaaaaucaauuuacgguuccagaauacaaaguacuuaauacauuuuuuuccaaaccuguuuguaucucaaaguuagcauuuuuguaaaucaagauacaaauaugauaacuucacuaaaauauuuuccagcuuuauucuuuaaggagcuguauaaccuucaaagucagggucccgaggucagcagggcauggggcagaaugcaccuggcacucccugugcagcagacugcaaccacauu

SEQ ID NO: 121 - RNA, 1266 nt, Homo sapiens
auggccagcuuucccccgaggguuaacgagaaagagaucgugagaucacguacuauaggggaacucuuggcuccagcagcuccuuuugacaagaaaugugguggugagaacuggacgguugcuuuugcuccugaugguuccuacuuugcguggucacaaggauaucgcauagugaagcuugucccguggucccagugccguaagaacuuucuuuugcaugguuccaaaaauguuaccaauucaagcugucuaaaauuggcaagacaaaacaguaaugguggucagaaaaacaagccuccugagcacguuauagacuguggagacauagucuggagucuugcuuuugggucuucaguuccagaaaaacagagucguugcguuaauauagaauggcaucgguuccgauuuggacaggaucagcuacuccuugccacaggauuaaacaauggucgcaucaaaaucugggauguauauacaggaaaacuccuccuuaauuugguagaccacauugaaaugguuagagauuuaacuuuugcuccagaugggagcuuacuccuuguaucagcuucaagagacaaaacucuaagagugugggaccugaaagaugauggaaacauggugaaaguauugcgggcacaucagaauuggguguacaguugugcauucucucccgacuguucuaugcuguguucaguuggcgccaguaaagcaguuuuccuuuggaauauggauaaauacaccaugauuaggaagcuggaaggucaucaccaugauguuguagcuugugacuuuucuccugauggagcauugcuagcuacugcauccuaugacacucguguguaugucugggauccacacaauggagaccuucugauggaguuugggcaccuguuucccucgcccacuccaauauuugcuggaggagcaaaugaccgaugggugagagcugugucuuucagucaugauggacugcauguugccagccuugcugaugauaaaauggugagguucuggagaaucgaugaggauuguccgguacaaguugcaccuuugagcaauggucuuugcugugccuuuucuacugauggcaguguuuuagcugcugggacacaugauggaaguguguauuuuugggccacuccaaggcaagucccuagccuucaacauauaugucgcaugucaauccgaagagugauguccacccaagaaguccaaaaacugccuguuccuuccaaaauauuggcguuucucuccuaccgcgguuag

SEQ ID NO: 122 - RNA, 1266 nt, Homo sapiens; identical to SEQ ID NO: 121

SEQ ID NO: 123 - RNA, 1287 nt, Homo sapiens
gaauuccgugugcaaggcgaggucuguaagcuggagcggggcagaggcuggcgggcaccccuuccugaccgcuggugccgccgccgccgccuucgggaggaucagacauggcccagaacuugaaggacuuagcuggacgccugcccgccgggccucggggcaugggcacggcgcugaagcugcugcugggggccggggcgguggccuacggcguccgcgaauccguguucaccguggaaggcggucauagagccaucuuuuuuaaucguauugguggcgugcagcaggacacgauccuggccgaauuucacuucaggauccccugguuccaguaccccaucaucuaugacauucgggccagaccucggaaaaucuccucccccacaggcuccaaagaccugcagauggugaacaucucccugcgugugcugucccgacccaaugcccaggagcuccccagcauguaccagcgucuagggcuggacuaugaggagcgagugcugccguccauuguuaaugaggugcucaagagugugguggccaaguucaaugccucgcagcugaucacccagcgggcucaggugucccuguugauccgaagagagcugacagagcgcgccaaggacuucagccucauccuggaugauguagcuaucacagagcugagcuucagccgagaguacacagcugcuguagaagccaagcaaguggcccagcaggaagcccagcgggcccaguuuuugguggagaaagcgaagcaggaacagcgacagaagauugugcaggcugagggggaggcggaggcugccaagaugcuuggagaagcacugagcaagaauccuggcuauaucaagcuccgaaagauccgggccgcccagaacaucucuaaaacgaucgccacaucacagaaccgaaucuaucucacagcugacaaccuugugcugaaucuacaggaugaaaguuuuacucggggaagugacagccucauuaaggguaagaaaugaguguggacaucaagaaccccaccaccagagaaguuggcacacuuguccagcuuggaggagccagcucggggucaagcacagcccacccugccccaggcaucaugugauggacuuuucuguaucugcccucuuggauuaaggaagacugagaccagcccuuucagaggcuuuccuccuuccuguguuggcugggaagcgggguggacaaugugauuucuccgugauuuccuacagccuugagccucucccagagugggggagauaaccaccaugccaggaauuc

SEQ ID NO: 124 - RNA, 612 nt, Homo sapiens
acccaccggcuuucggaccauggccaaccucgagcguaccuucauugccaucaagccagauggcgugcagcgcggccuggugggcgagaucaucaaacgguucgagcagaagggguuccgccugguggccaugaaguuccuucgggccucugaagaacaccugaagcagcauuacaucgaccugaaagaccguccuuucuucccggggcuggugaaguacaugaacucggggcccgugguggccauggucugggaggggcucaauguggugaaaacgggccgagugaugcugggggagaccaauccagcugauucaaaaccaggcaccauccguggggauuucugcauucaaguuggcaggaacaucauucauggcagugauucaguggagagugcugagaaagagauccaucugugguuuaagcccgaagaacugaucgacuacaagucuugugcccaugacuggguguacgaguagacaugaagaaaccagaauccuuuucagcacuacugauggguuucuggacagagcucuucaucccacugacaggauggaucaucuuuucuaaaacaauaaagacuuuggaacugaaaaaaaaaaaaaaaaaaaaa

SEQ ID NO: 125 - RNA, 529 nt, Homo sapiens
uuuugcuuucaacaugacagaugccgcuguguccuucgccaaggacuucuuggccgguggaguggccgcagcaucuccaagacagcggucacaccaucgagagggucaagcugcugcugcaggugcacaugccagcaagcaaaucacggcagauaagcaauacaagggcaucauagacugcgugguucguauccccaaggaacagggagugcucugguccuuugggcgugggaaccgggccaaugucaucagauacuuccccaccaaggcucucaacuuggccuucaaaguuaauuccaagcagaucuuucugggugguguugacaagaggacccaguucuggcgcuacuuuugcagggaaccuggcaucaggugguugccgcuggggcuacauccuugggcuuuguguacccucuugauuuuugccgguaccgucuagcagcugaugugggcaagcuggagcuaaagggaauucaagggccuugggacugccugguaagacuucaaucugaugggauaagggcuguac

SEQ ID NO: 126 - RNA, 291 nt, Homo sapiens
auccgggacccccacggccccuuugcagcuugccacaagguucugagccccuuggaauacuuccgccaauguguguaugacaugugugcccauaagggugacaaagccuaucucugccguagccuggcugcuuauacugcagccugucaggcagcuggggcagcagugaagcccuggaggacagacagcgucugcccucuccaguguccugcccacagccacuacuccaucugcacccgcuccugccagggcuuccugugcugcucucucuggccucacuggcugcaccac

SEQ ID NO: 127 - RNA, 3454 nt, Homo sapiens
ggcacgagccgaguuggaggaagcagcggcagcggcagcggcagcgguagcggugaggacggcugugcagccaaggaaccgggacagcgaagcgacggcaggucgcagcuggaucgcaggagccugggagcugggagcuucagaggccgcugaagcccaggcugggcagaggaaggaagcgagccgacccggaggugaagcugagaguggagcguggcaguaaaaucagacgacagauggacagugugacaggaacgucagagaggauugggccucgcugcgagagucagccuggagucaagguguugacaaguugcugagaaggacacgugggaggacgguggcgcgcggagggagagcccugucuucagucaccccguugauggaggacagauggacagcagccggacggccagucaccucucuuaaaccuuuggauagugguccuuugugcucugcuggacaccuguuggggauuuuagcccauucucugaacucacuuucucuuaaaacguaaacucggacggcagugugcgagccagcuccucuguggcagggcacuagagcugcagacaugagugcagagggcuaccaguacagagcacuguacgacuacaagaaggagcgagaggaagacauugaccuacaccugggggacauacugacugugaauaaaggcuccuuaguggcacuuggauucagugauggccaggaagcccggccugaagauauuggcugguuaaauggcuacaaugaaaccacuggggagaggggagacuuuccaggaacuuacguugaauacauuggaaggaaaagaauuucacccccuacucccaagccucggcccccucgaccgcuuccuguugcuccggguucuucaaaaacugaagcugacacggagcagcaagcguugccccuuccugaccuggccgagcaguuugccccuccugauguugccccgccucuccuuauaaagcuccuggaagccauugagaagaaaggacuggaauguucgacucuauacagaacacaaagcuccagcaacccugcagaauuacgacagcuucuugauugugaugccgcgucaguggacuuggagaugaucgacguacacgucuuagcagaugcuuucaaacgcuaucucgccgacuuaccaaauccugucauuccuguagcuguuuacaaugagaugaugucuuuagcccaagaacuacagagcccugaagacugcauccagcuguugaagaagcucauuagauugccuaauauaccucaucaguguuggcuuacgcuucaguauuugcucaagcauuuuuucaagcucucucaagccuccagcaaaaaccuuuugaaugcaagaguccucucugagauuuucagccccgugcuuuucagauuuccagccgccagcucugauaauacugaacaccucauaaaagcgauagagauuuuaaucucaacggaauggaaugagagacagccagcaccagcacugccccccaaaccacccaagcccacuacuguagccaacaacagcaugaacaacaauauguccuugcaggaugcugaaugguacuggggagacaucucaagggaagaagugaaugaaaaacuccgagacacugcugaugggaccuuuuugguacgagacgcaucuacuaaaaugcacggcgauuacacucuuacaccuaggaaaggaggaaauaacaaauuaaucaaaaucuuucaccgugauggaaaauauggcuucucugauccauuaaccuucaacucugugguugaguuaauaaaccacuaccggaaugagucuuuagcucaguacaaccccaagcuggaugugaaguugcucuacccaguguccaaauaccagcaggaucaaguugucaaagaagauaauauugaagcuguagggaaaaaauuacaugaauauaauacucaauuucaagaaaaaagucgggaauaugauagauuauaugaggaguacacccguacuucccaggaaauccaaaugaaaagaacggcuaucgaagcauuuaaugaaaccauaaaaauauuugaagaacaaugccaaacccaggagcgguacagcaaagaauacauagagaaguuuaaacgcgaaggcaacgagaaagaaauucaaaggauuaugcauaaccaugauaagcugaagucgcguaucagugagaucauugacaguaggaggagguuggaagaagacuugaagaagcaggcagcugaguaccgagagaucgacaaacgcaugaacaguauuaagccggaccucauccaguugagaaagacaagagaccaauacuugauguggcugacgcagaaaggugugcggcagaagaagcugaacgaguggcuggggaaugaaaauaccgaagaucaauacucccugguagaagaugaugaggauuugccccaccaugacgagaagacguggaaugucgggagcagcaaccgaaacaaagcggagaaccuauugcgagggaagcgagacggcacuuuccuuguccgggagagcaguaagcagggcugcuaugccugcuccguagugguagacggcgaagucaagcauugcgucauuaacaagacugccaccggcuauggcuuugccgagcccuacaaccuguacagcucccugaaggagcuggugcuacauuaucaacacaccucccucgugcagcacaaugacucccucaaugucacacuagcauacccaguauaugcacaacagaggcgaugaagcgcugcccucggauccaguuccucaccuucaagccacccaaggccucugagaagcaaagggcuccucuccagcccgaccugugaacugagcugcagaaaugaagccggcugucugcacaugggacuagagcuuucuuggacaaaaagaagucggggaagacacgcagccucggacuguuggaugaccagacguuucuaaccuuauccucuuucuuucuuucuuucuuucuuucuuucuuucuuucuuucuuucuuucuuucuuucuuucuuucuaauuuaaagccacaacacacaaccaacacacagagagaaagaaaugcaaaaaucucuccgugcagggacaaagaggccuuuaaccauggugcuuguuaacgcuuucugaagcuuuaccagcuacaaguugggacuuuggagaccagaagguagacagggccgaagagccugcgccuggggccgcuugguccagccugguguagccugggugucgcuggguguggugaacccagacacaucacacuguggauuauuuccuuuuuaaaagagcgaaugauauguaucagagagccgcgucugcucacgcaggacacuuugagagaacauugaugcagucuguucggaggaaaaaugaaacaccagaaaacguuuuuguuuaaacuuaucaagucagcaaccaacaacccaccaacagaaaaaaaaaaaaaa

SEQ ID NO: 128 - RNA, 199 nt, Homo sapiens
  misc_feature (136)..(136): n is a, c, g, or u
uuuuuuuuuuuuguuuuaauuuggcuccaaugaucgcauucucaaacuccuuugggagggcauuagaugacccaguauccgacgacuuagauucacacguguuuuucuccucugagcucuuuucuccaggcucacngucuuuguuuuucaagcuuucuugggccuuugaacaauuuucuuccuuugaagauucuccugg

SEQ ID NO: 129 - RNA, 1706 nt, Homo sapiens
agccgaguaggaccgagcugcugcagacgcgccgggucacucgagccagcaccaccguucucacgcccugagcugcagacagcuaggcgguuuuaucuaguuugaaccaggcugcuggagcuugcucccucccgcccucucucuuuuuuuuccacggggcuguuuuuuuaauuuggcugcaauugcaugaaaucccaaugguguagaccaguggcgauggaucuaggaguuuaccaacugagacauuuuuccauuucuuucuugucgucuuugcugggaaccgaaaacgcuuccgugagacuugacaauagcucuggugcaagugugguagcuaucgacaacaaaauagagcaagcuauggaucuggugaaaagccauuugauguaugcggugagggaggaaguggaaguucugaaggagcagaucaaagaacuaauagagaaaaacucccagcuggagcaggagaacaaucugcugaagacgcuggccaguccggagcagcucgcccaguuucaggcccagcugcagacuggcuccccuccggccaccacgcagccacaggggaccacacagcccccugcacagccagcaucccagggcucaggaucaaccgcauagccuccuaggccccaacagaacuggcugcugcugcugcugucugaacugaacagaccgaagagaugugcuagagagaagccgccuccacagucacccauuucauugcugucuacgaaagagacgugagacucacacgcuguucucgcuuucuccccaguauuaagcacucauaagcuuuuggcuugaagaaauguacuaguugagugaauuaaagguuaaucagagagugagcagggaugugcccugugcaacguggcagaugucugaggaaugguuuaauugaccccgaggagcucugugccuuuucaacccuccccagccgcccacccugcuucugagagcucgggcggcucgccuucguggggcucgccugcgugggguucgaaagugggcugcuccuggauucugcgcucucuucuccuucccuucaaagaacucggagaggccagaaacaagacugcaauggggggcggggggagggaugaugcaguccuuauacaaaaccgacaacugucaccaaagcuuauaaaacacgauaguacugucccucuuuucugaaccaucagaagacacaaaacuguuagugacacaacggugacagguagcugggaccuaggcuaucuuauuaugaagguuguuuugcuuguuguauauuuguguauguaguguaacgaauuuguaccauagaggacuguccguaacuacuguuuagcuucuacacauugaaauguagauguuucauuggcugucugaaaagguguggcuuguccuuccuagagagaucuacuuaaaaacugcuuuguggcaaaaaccacaccugaagaaauuuuaagaauuuggcccaguuagucacucuguguaaucccggaaucuagcugcugaagucuugcgaaguaaacuccccgugaccgaugucaguuaagcuggugauaccuggagaaguggucaguugcuaaggaaguggauuucccaguagggguuucugcaccucaccuguauagucguucugcgcaugucccccacacaguccccaccuguauuuaccuguucuacuugucaccuuucaauaaagcauaucaaauguugau

SEQ ID NO: 130 - RNA, 2175 nt, Homo sapiens
auggcugcgcacgucuggcuggcggccgcccugcuccuucugguggacuggcugcugcugcggcccaugcucccgggaaucuucucccuguugguucccgaggugccgcugcuccgggucuggguggugggccugagucgcugggccauccuaggacuagggguccgcgggguccucggggucaccgcaggagcccauggcuggcuggcugcuuugcagccgcugguggccgcacugaguuuggcccugccuggacuugccuuguuccgagagcuggccgccuggggaacacuccgggagggugacagcgcuggauuacuguacuggaacagucguccagaugccuucgcuaucaguuauguggcagcauugcccgcagccgcccuguggcacaaguuggggagccucugggcgcccagcggcaacagggacgcuggagacaugcugugucggaugcugggcuuccugggcccuaagaagagacgucucuaccugguucugguucucuugauucucucuuggcuuggggaaauggccauucccuucuucacgggccgcaucacugacuggauucuucaggauaagacaguuccuagcuucacccgcaacauauggcucauguccauucucaccauagccagcacagcgcuggaguuugcaagugauggaaucuacaacaucaccaugggacacaugcacggccgugugcacagagagguguuucgggccguccuucgccaggagacaggguuuuuccugaagaacccagcagguuccaucacaucucgggugacugaggacacagccaacgugugcgaguccauuagugacacgcugagccugcugcugugguaccuggggcgagcccugugucucuugguguucauguuuugggggucaccguaccucacucuggucacccugaucaaucugccccugcuuuuucuuuugccuaagaagcugggaaaagugcaccagucacuggcagugaaggugcaggagucucuagcaaaguccacgcagguggcccuugaggccuuaucggcgaugccuaccgugcggagcuuugccaacgaggagggugaggcccagaaguucaggcagaaguuggaagaaaugaagacgcuaaacaagaaggaggccuuggcuuacgucgcugaagucuggaccacgagugucucgggaaugcugcugaaggugggaauucuguaccugggcgggcagcuggugaucagagggacugucagcagcggcaaccuugucucauucguucucuaccagcuucaguucacccaggcuguucagguccugcucucccucuaccccuccaugcagaaggcugugggcuccucagagaaaauauucgaauacuuggaccggacuccuugcucuccacucaguggcucguuggcacccucaaacaugaaaggccuuguggaguuccaagaugucucuuuugccuacccaaaccagcccaaaguccaggugcuucaggggcugacguucacccugcauccuggaacggugacagcguuggugggacccaauggaucagggaagagcaccguggcugcccugcugcagaaccuguaccagcccaccgggggccagcugcugcuggauggccagcgccugguccaguaugaucaccauuaccugcacacucagguggccgcagugggacaagagccgcugcuauuuggaagaaguuuucgagaaaauauugcguauggccugaaccggacuccaaccauggaggaaaucacagcuguggccguggagucuggagcccacgauuucaucucuggguucccucagggcuaugacacagagguaggugagacugggaaccagcugucaggaggucagcgacaggcaguggccuuggcccgagccuugauccggaagccacuccugcuuaucuuggaugaugccaccagugcccuggaugcuggcaaccagcuacggguccagcggcuccuguaugagagccccaagcgggcuucucggacgguucuucuuaucacccagcagcucagccuggcagagcaggcccaccacauccucuuucucagagaaggcucugucggcgagcagggcacccaccugcagcucaugaagagaggagggugcuaccgggccaugguagaggcucuugcggcuccugcagacuga

SEQ ID NO: 131 - RNA, 970 nt, Homo sapiens
gaauuccggggccgcucucuccggcaggaucgccgcgauggccgcccagggagagccgcagguccaguucaaggucguccuggugggcgacggcggcaccggaaagacgacauucaugaagcgccacuugaccggagaguuugagaaggaguauguagccacccugggcguggaggugcacacauuagucuuccauaccaacagaggaccuaucaaguucaaugugugggacacagccggucaggagaaguucggggggcugcgcgauggcuacuacauccaagcccagugugccauuauaauguuugacguaacaucaagaguuacuuacaagaaugugccuagcuggcauaaagaucuagugcgugugugugaaaacauccccauuguauuguguggcaacaaaguggauguuaaagacaugaaagugaaggcaaaaccuauucucuuccaccgaaagaagaaucuucaguacuaugacauuucugccagaaguaacuacaacuuugaaaagccuuucuucuggcuugccagaaagcucauuggagauccuaacuuggaguucguugccaugccugcucuugccccaccugagguagucauggacccagcuuuggcagcacaguacgagcaugauuuagagguugcucagacgacugcucucccagaugaggaagaugaccugugagaaagugaagcuggagcccugcgucagaagucuauuuuaggcaacuguccugugaugccagccagcggugcagugugugugccaccuuauuuagcuaaaggagaucgugcaauucauugggaugcugaaggagaugaaugggcuucggagugaauguggcaguuaaaauacaccuucauuuuuuuggacuugcguauuuagcccccuggaacagaguuguucuggauuucaaagauaagacugcuaccguagcaucacaauagucaguggugaccggaauuc

SEQ ID NO: 132 - RNA, 356 nt, Homo sapiens
uuuuuuuuuuuuuuuuugauuuaugaaaaguuuuauuuaucaguacugugaagaauucucaucauaauugcuacguuaaucaaggaaaaggcacagagaagcaugugucguuugaguccucgauacuggaccucccagcccaugcucccuaugaggagucuagcugcugugguggucuucacagcuuugguuuucuggagacgaagcucaugauugcguucaugcacuccucugacagccaccuugcuugcagaguagugcacucuucagcguugacugcguagagcuuuucuuucucauuuuuucugauuaacucuuuggaaauucucauuggguuuggcgggagcuucgcauau

SEQ ID NO: 133 - RNA, 626 nt, Homo sapiens
ucgggaaucgauugagagaccgcgaaccuguaaacggaugauaccgagucgggcaggcguuaugccagcccaacucgggaccucgcaucauguccgcggcuaccuuagaguguuucgggaaugauuugcgguggaugaacgaaaccccgguacguccugugccaaggagcauaugucaggacggacgcucguuaaugccucagugguggggcaacguucgcucucuaucuauacgacucucgacaauggauaucucggcucucgcaucgaugaagaacguagcgaaaugcgauacuuggugugaauugcagaauccugugaaccaucgagucuuugaacgcaaguugcgcccgaggccuuucgguugagggcacgccugccugggcgucacgccuuguuuugcucugugcccgugcucuuucgggggcggucauggaugcggagauuggcccuccgugccucgugugcggcgggcuuaagcgcggggugucggcgucgggaagggcacgacgagugguggacggagcaccagcaggauguuguggucccccgucaccuuaaggggcucaagagacccggacuaggcgagccgcgcuucguaagaggagggcgagcugucucgcaau

SEQ ID NO: 134 - RNA, 495 nt, Homo sapiens
  misc_feature (485)..(485): n is a, c, g, or u
uuuuuuuuuuuuuuuuugaaguugcugccccuuuauuggugacccgggcaaguuuaaggagaacaacauuaaagcacacaaaguguauccaugucaccagcucaaccaggaggagugagggucacggcaggguucucccaugguguaagaaaucaacgcaauuucaucacaccccguuacuuuccaaguuaacgaaccgauaagaaaagauucucccuuaaacugacaaguacaauguacauguacaugauuuuggaauaauuuaauacuuuaaccucaagauacaacuauauucuaagaccauuauuuuaaaggaacggauccuuacaaaaccaaaauaacccauauagcacgagguugguuuagccuuucuucuucuuucaacaaacgugcaccacauguuucaguagcaaggccgaugccauggauaugagagcugugauuugcagggaccaaccacaucuagaaccggggaggccaaucanacgguggguu

SEQ ID NO: 135 - RNA, 257 nt, Homo sapiens
  misc_feature (254)..(254): n is a, c, g, or u
cccuuggaggauaguuuuauugacaagucgaguuagguuuuagaguaaacuuuuaucaccccagucaggccccuucccaggggaggcucgcugguagcucagauggccuugguggugggcagauuguuguaguugucuuccuggcccuccagcaggcuucgggagguggcuaucuccugcuccagccuggacuugauguccaguagcugcuuauacuccggguucuggcgcucuaugugcggcacgcaggugcngcg

SEQ ID NO: 136 - RNA, 1186 nt, Homo sapiens
ggacugacuccuugggcagauugccucuccuccuucucaugccagaggcugcugaugaggaaagguccaggggacuguccaugcugucuucauccucagagucacugccugaugcugcaacaagacccuucuuguuuagcaauagugguuggaacacucucuuguaaguuaccggagcacuaguauaggaggaggaucaucgacuacccucccgccacuccacggcugcuggcuccuagaaaccccagcuucaccucucacugggacucgaguuccagaaugaaaagcaagaagggucuuguugcagcaucaggcagugacucugaggaugaagacagcauggacaguccccuggaccuuuccucaucagcagccucuggcaugagaaggaggagaggcaaucugcccaaggagucaguccagauucugcgagacuggcuguaugaacacagauacaacgccuaucccucagagcaagagaaagcacugcugucccagcagacacaccuguccacacuacaggucuguaacugguucaucaacgcccgccgcaggcuccuuccugacaugcugagaaaggauggcaaagauccaaaucaguucacgauuucccgccguggggccaagauuucagaagcuagcucuauugaagcugcaauggguaucaaaaacuucaugccaacucuagaagagagcccauuucauuccugcguaguuggacccaacccaacccuagggagaccagugucucccaaaccucccuccccaggauccauuuuggcucgcccgucagugaucugccauaccacugugacugcauugaaggaugggccuuucucucucugucagccgauuggugugggacagaguacagauguaccgcaaauagcacccagcaacuuuacagacaccucucucguguacccagaggacacuugcaaaucuggacccaguccaaacccucagaguggucuuuucaacacuccucccccuacuccaccagaccucaaccaggauuuuaguggauuccagcuucuaguggauguugcacucaaacgagcggcagagauggagcuucaggccaaacucacagcuuaaccguuuuuucaaacaaaacaguucuccaaaauacgguccugauugccgggggugauggcaagagaugcauuauuuuauauauuuuuuc

SEQ ID NO: 137 - RNA, 455 nt, Homo sapiens
uuuuuuuuuuuuuuuuuggugguuaucaagugcacuuuauugaauccacuguggauagauaaaugaguguuacaccugcguguagggaggggcaaggagggacgcagcugcggagggugaagcacuucaggaccggaagucggaauccucuauuaagugugaagguuuugagcguuaagaacaaugaugaugacacuaacaauggugauaacaaccaucaggaugcugaggaccaaggugcugauguucaggcacuuagcaguggaggcguaggccugggcuccagucacaucacccaccaucuuccgaucccuagacuucacggaguaggcauaggcuaugaagcccaggcagcagaaguucaugaagaguguauugaacagggaccagaccacauggucaggcaccgacaccucucugggcauguugaucacaguaguucugacagaagccga

SEQ ID NO: 138 - RNA, 1797 nt, Homo sapiens
aagcuucaggauacagugcacacucguaaauaaaaacuacaggcugcugcgaauuauauuucaacugaccggagaggcaaagccugacuguccauuaacccuuaacuuccaaacgcaaacugcuuacugcaucuuuuggcauuuuaccuuaugccuuguuagguccaaggcaagagaagcgucaucaauaaccacgcaugugcaacagcuuuuccagaggaaagguguggguggcucuuaaaagagccuuugaguuaggagugugaguuaaacgagcucacuuggagcugguguacuuggugacugccuuggugcccuccgacaccgcgugcuuggccagcuccccgggcagcagcaggcgcacggccgucuggaucucccgggacgugauggucgagcgcuuguuguaaugcgccaggcgggaagccucgcucgcgaugcgcucgaagaugucguucacgaacgaguucaugaugcccauggccuuggaggagaugccggugucggggugcacuugcuucagcaccuuguacacguacaccgaguagcucuccuugcggcugcgcuugcgcuucuugccguccuucuucugggccuuggugacggccuucuuggagcccuucuucggggcgggagcggacuuggcgggcucaggcauacugagaggaugaagugaacuaaguugaaaaaggauaacuaaaaguuaaugacuguucuggcugcaauuuuaaacaaacuuacggcuauggcaaccugaaucaccauacgucauguacuaacaguccaaucaaaacaagggauuuucaaaccagggcgccauugguaaccaauguguaaccaaugaaaucucuccguuuucgcguccagccuugacuauauauacuaugcguauacguuuuugcuucuuacugcggugguuaucuacagcugaguuaugucuggacguggcaagcaaggacguggcaagcaaggaggcaaggcccgcgccaaggccaagacgcgcuccucccgggccggccugcaguuccccgugggccgcgugcaccggcugcuccgcaagggcaacuacucggagcgcgugggcgccggcgccccgguguaccuggcggccgugcuggaguaccugacggccgagauccuggagcuggcgggcaacgcggcccgcgacaacaagaagacgcgcaucaucccgcgccaccugcagcuggccauccgcaacgacgaggagcucaacaagcugcugggccgcgugaccaucgcgcagggcggcguccugcccaacauccaggccgugcugcugcccaagaagaccgagagccaccacaaggccaaggggaagugaaaccaaacauuacgaaucaccaaggcucuuuucagagccacucacuuucucaaagagaccuaacacuacugggauagugcauugugggaaauacguguauuaaccuuccuccuauuuucccugcuugugguuaguucaaccccuaagccuuaggcuaagaguauauugguuuuuggaaggcaggcacccaaccucggaccuaguacauaaaacagacacaucuugaacuccaggccagccuacucugcaggacgaguuccaggacagaccggacugcacaaagaauugucuugaaauguuccuuuaucagcacauaugcugauaaacaacuaaucacuguacaaucaauccucacuugaauccuguuuauguggcaugauugacaaguccugccauuuggcaaagucaaaaucagcaaaggauguuaaagcauuuggugguaucacagcuaaaac

SEQ ID NO: 139 - RNA, 376 nt, Homo sapiens
uuuuuuuuuuuuuuuaugcaaauaguuuucaagauuuuauugcaaaccaaaauugguuuaucgcacacaaaaaaaguugugugguaaggaggaggaauuguacaggauuauaacccauguuaauuacaguacauuaaaaugaugguuuacaaauaagccuguaaguuuaaauaucuaguguuauaacccaauguacagacuuccuuuacacgauacauacaauaaucaggaaugcaaaagaauaugaacaaagggaaaaaaaacauaaauaaugcccguuuuauaggugacauuuuaaacaauugaaaacaccaaccggcuuugacugacaacuggggcauugguccauaaaaacccuuucuaaaaauagaaauau

SEQ ID NO: 140 - RNA, 1068 nt, Homo sapiens
gaggcugcucaagagcugcgguugggucaccgcuucauguuucucugccgauucuggggaaagauggcaacgaaugaugcuguucugaagaggcuggagcagaagggugcagaggcggaucagaucaucgaauaucucaagcagcagguugcucuucuuaaggagaaagcaauuuugcaggcaacaaugagagaagaaaagaaacuucgaguugaaaaugcuaaacugaaaaaagaaauagaagagcuaaagcaagagcugauucuggcagaaauucauaacggaguggagcaagugcguguucgauugaguacuccacugcagacgaacuguacugcuucugaaaguguggugcagucuccaucaguagcaaccaccgccucuccugcuacaaaagagcagaucaaagcgggagaagaaaagaaggugaaagagaagacugaaaagaaaggagagaaaaaggagaagcagcagucggcagcagcaaguacugacuccaagccuaucgacgcaucgcgucuggaucuucgaauugguuguauuguuacugccaagaagcacccugaugcagauucacuguauguggaggaaguagaugugggagaagcagccccgcgcacggucgucagcgggcuggugaaucauguuccucuagaacagaugcaaaaucguauggugguuuuacucuguaaucugaagccugcaaagaugcggggaguucugucucaagccauggugaugugugccaguucaccagagaaaguggagauucuggccccucccaacggguccguuccuggggacagaauuacuuuugaugcuuuuccuggagagccugacaaggagcuaaacccuaagaagaagaucugggagcagauccagccugaccugcacaccaaugcugaguguguggccacauacaaaggagcucccuuugaggugaaggggaagggaguuugcagagcccaaaccauggccaauaguggaauuaaauaagugcucuguaacugaaagacauuggcgaaaacuuaauaacaauaaagagaaguguguuuaucacuuacauau

SEQ ID NO: 141 - RNA, 165 nt, Homo sapiens
ggccuuguuuuugguuugcaauaaagaguauuucuuuaaaaggcacauuuuguuaaauaggcaguuccccuccugccucuuccuuuguagcaguguacugcauccuagaaacauuuagcaaagcagcccuuagccuccccgacccccuuucccucccucccagca

SEQ ID NO: 142 - RNA, 324 nt, Homo sapiens
uuuuuuuuuuuuuuuuuaaacaaugacgccguuuauuuaaaauguuuacucccagaaauauagauauaaaaaaaaaaauaagacaauuaacagcacuaaaccaggcaccuucaaccgaaucccaccauccucguuaacucccuuccuguuacccuuuguagaugaccagaagauuucaggagccccuggacagccagagugguuccugcccagggcuucccgccuuccuccuguccuagagcuucccgugggaaagcuugggugagaauuuuagccuaaagggagggggcuguggccgggcacuuugcgcucauccacugcagg

SEQ ID NO: 143 - RNA, 2473 nt, Homo sapiens
acaggguacaguugugcgucagggcguggaggucuggcgggagacgcauaguuacagcgcguccguucuccgucucgcagccggcacagcuagagcuucgagcgcagcgcggccauggaucccagcagcaagaaggugacgggccgccucauguuggcugugggaggagcagugcucggaucacugcaguucggcuauaacacuggugucaucaacgccccccagaagguuauugaggaguucuacaaucaaacauggaaccaccgcuacggagagcccaucccauccaccacacucaccacgcuuuggucucucuccguggccaucuucucugucgggggcaugauugguuccuucucugucggccucuuuguuaaucgcuuuggcaggcggaacuccaugcugaugaugaaccuguuggccuuuguggcugcugugcuuaugggcuucuccaaacugggcaaguccuuugagaugcugauccugggccgcuucaucaucgguguguacugcggccugacuacuggcuuugugcccauguaugugggagaggugucaccuacagcucuacguggagcccuaggcacacugcaccagcugggaaucgucguuggcauccuuauugcccagguguuuggcuuagacuccaucaugggcaaugcagacuuguggccucugcugcucagugucaucuucaucccagcccugcuacaguguauccuguugcccuucugccccgagagcccccgcuuccugcucaucaaucguaacgaggagaaccgggccaagagugugcugaagaagcuucgagggacagccgaugugacccgagaccugcaggagaugaaagaagagggucggcagaugaugcgggagaagaaggucaccaucuuggagcuguuccgcucacccgccuaccgccagcccauccucaucgcuguggugcugcagcugucccagcagcugucggguaucaaugcuguguucuacuacucaacgagcaucuucgagaaggcaggugugcagcagccuguguacgccaccaucggcuccgguaucgucaacacggccuucacuguggugucgcuguuuguuguagagcgagcuggacgacggacccugcaccucauuggccuggcuggcauggcaggcugugcugugcucaugaccaucgcccuggccuugcuggaacggcugccuuggauguccuaucugagcaucguggccaucuuuggcuuuguggccuucuuugaaguaggcccugguccuauuccaugguucauuguggccgagcuguucagccaggggccccguccugcugcuauugcuguggcuggcuucuccaacuggaccucaaacuucauugugggcaugugcuuccaguauguggagcaacugugcggccccuacgucuucaucaucuucacggugcuccucgugcucuucuucaucuucaccuacuucaaagucccugagaccaaaggccgaaccuucgaugagaucgcuuccggcuuccggcaggggggugccagccaaagugacaagacacccgaggagcucuuccacccucugggggcggacucccaagugugaggagccccacacccagcccggccugcucccugcagcccaaggaucucucuggagcacaggcagcuagaugagaccucuuccgaaccgacagaucucgggcaagccgggccugggcgccuuuccucagccagcagugaaguccaggaggauauucaggacuuugauggcuccagaauuuuuaaugaaagcaagacugcugcucagaucuauucagauaagcagcagguuuuauaauuuuuuuauuacugauuuuguuauuuuuuuuuuuuaucagccacucuccuaucuccacacuguagucuucaccuugauuggcccagugccugaggguggggaccacgcccuguccagacacuugccuucuuugccaagcuaaucuguagggcuggaccuauggccaaggacacacuaauaccgaacucugagcuaggaggcuuuacgcuggaggcgguagcugccacccacuuccgcaggccuggaccucggcaccauagggguccggacuccauuuuaggauucgcccauuccugucucuuccuacccaaccacucaauuaaucuuuccuugccugagaccaguuggaagcacuggagugcagggaggagagggaagggccaggcugggcugccagguucuagucuccugugcacugagggccacacaaacaccaugagaaggaccucggaggcugagaacuuaacugcugaagacacggacacuccugcccugcuguguauagauggaagauauuuauauauuuuuugguugucaauauuaaauacagacacuaaguuauaguauaucuggacaaacccacuuguaaauacaccaacaaacuccuguaacuuuaccuaagcagauauaaauggcugguuuuuag

SEQ ID NO: 144 - RNA, 2125 nt, Homo sapiens
gcuuucuaaacuagcaagcaucguguggguccuucaggagugggagugcagacagaccugacagcguccgcuaagcgacacugacuguacuuccacuccugaaggacccacacgaugcuuucuaaacuagcaagucugcagaccauugcugcucugcgccgaggaguccacaccucagucgccucugccacgucuguugccacaaagaagacagagcaaggcccaccauccuccgaguacauuuuugaacgggaaucuaaauauggugcacacaauuaccauccuuugccuguagcccuggagagaggaaaaggcauuuauaugugggauguggaaggcaggcaguacuucgauuuccugagugcuuauggugcugucagccaaggacacugccacccaaagaucauagaugccaugaagagucagguggacaagcugacauuaacaucucgggcuuucuauaacaauguccuuggugaauacgaggaguacaucaccaagcuuuucaacuacaacaaaguucucccuaugaauacaggaguggaggcuggagagacugcauguaagcucgcucgucguuggggcuacaccgugaaaggcauccagaaauacaaagcaaagauuguuuuugcugaugggaacuuuuggggucgaacacuaucugcaaucuccaguuccacagauccgaccaguuaugauggcuuuggacccuucaugccaggcuuugaaaccaucccauauaacgaucugcccgcacuggagcgugcucuucaggauccaaauguugcugccuucaugguggagcccauccagggugaagcaggcguuaucguuccggauccaggauaccugacaggaguucgggaacucugcaccaggcaccagguccuguuuauugcugaugaaauacagacaggauuggccagaacugguagauggcuggcuguggaucaugagaaugucagaccugauaugguucuucuugggaaggcccuuucuggcgguuuauacccugugucugcagugcugugugacgaugagauaaugcugaccauuaaaccaggcgagcacggcuccacauacggcggaaacccacuaggcugccgaauugccauugcggcucuugagguuuuagaagaggagaaucuugcugagaaugcagacaagaugggcgcuauccugaggaaggagcucaugaagcugcccucugacguugugaccucagugagagggaaaggguugcuaaaugccauugucaucagagaaaccaaagacugugaugcuuggaaggugugccugcgacuucgagauaacgggcuucuggccaagccaacccacggugauaucaucaggcuugccccuccccuugugaucaaggaggaugagauccgggaguccguggagaucaucaacaagacuaucuuguccuucugagaguaggaacucuggggagccaucuucagacagggcucuugugaaacucugcuugcaguggccagagccugucuccugaaaggcauauauuucaguugaugcauaauagagugacaccuaggaaccugcagguggcugcgugacagaaaagugagagcgagaggcgaggcgucucuuuguugagguuugacugugugggaacuuucuaaggagaaacggacccaucugcguacagccugcagauggaggccugcagucauuuacgugcgucuuuacaguuuccuugcugaugugaaugguuuguauuuagaaguuauuucugagauacuacagaacaguuaaaucauuauaaucaaugaauguuaaguugauugaagguuaagcauauguaaaauacuaguuuaaaguaaacuuuucauuggccaacaccagaauguauuauauagauucugagaauucauuacuaaauuacacuuugcuugauugcaauuuguaaaacauuuauuuucaguauuucuuugaauaaagcuuaauguuucuuuuuacgccaacagaguauuuuguauuuccauuuugguaauaaucaguguauuauuucauccugaugacuggcauuucaucaccuauugagaucacuggguguguuucaggccuuuuauucuaaauaaagcuaugaccaguuucugucugu

SEQ ID NO: 145 - RNA, 199 nt, Homo sapiens
uuuuuuuuuuuucuuuuccgacgcccacaagaggaauaagagauuuaaugauggaaaguauggggaaaucacaguuuucagacaugaguaaucaaaaacuugacauuuuucuugauauccaaaucuagaugucuguaucaaaccagaggugauggccuuggggauggcagugaagacuguuaggaccauuagaucagau

SEQ ID NO: 146 - RNA, 412 nt, Homo sapiens
uuuuuuuuuuuuuuuuuacaguuuuaaaacaauacacagcuuucucgggcugaagcaauugcaagaacguauugguauugguauauuacagcuacauacaagguuuaugaauagcaauggagaaaaauaaguuauuuaaauauugacuucauaaagagaaagugcaauguuguuaguugucauaucacuugcuugacaguuugugggguuucuucccuaucaauuuuaacaaucaagauaacauggacucaagacagaauuuuucgggaaccucacucaguccucacacagcagugacuugggaaucuacguguguuccaccgcaguugugaaacacacuacuccguguccaggacucauuucucagagaagaaucaauucgaguuccauccacaccuggggucgggacaca

SEQ ID NO: 147 - RNA, 2373 nt, Homo sapiens
ccgggcucgaauucucuagacucgaguuuagagaauucgagcucucccaguuuuaaagcaaaauuuuggacugugaagcaaggcacugggcaaacacaacauggccuccccggcugacagcuguauccaguuuacccggcacgcuagugauguucuucucaaccuuaaucgccuccggagucgggacaucuugacggacguugucaucguggugagccgugagcaguuuagagcccauaagacagugcucauggccugcagcggccuguucuacaguaucuucacugaccaguugaaaugcaaccuuaguguaaucaaucuagauccugaaaucagcccugagggguuuugcauccuccuggacuucauguacacaucuaggcucaaccugagggaaggcaauaucauggcggugaugaccacagccauguaccugcagauggagcauguugucgacacaugcaggaaguucaucaaggccagugaagcagaaauggccccugcacuuaaaccuccccgugaagaguuccugaacagccggaugcugaugccccaugacaucauggccuaccgaggucgugaggucguggagaacaauaugccacugagaaauacucccgggugugagagcagagcuuuugcuccuccucuguacaguggccugucaacaccaccagccucuuaucccauguacagccaucucccgcucagcaccuuccucuucucugaugaggagcuccgagaugccccccgaaugccuguggccaacccuuuucccaaggagcgugcccuccccugcgacagugccaggcaagucccuaaugaguauagcaggccagccauggaggugucccccaguuugugucacagcaacaucuacucgcccaaggaggcagucccagaggaggcucggagugacauacacuacagugugccugagggccccaagccugcugucccuucugcucggaaugcuccauacuuccccugugacaaagccagcaaagaagaagagagaccuucuucggaggaugagauugcccugcauuucgagccccccaaugcacccuugaaccggaagggucugguuaguccccagaguccccagaaauccgacugccagcccaacucacccacagaguccugcagcagcaagaacgccugcauccuucaggccucuggcucuccgccagccaagagccccacugacccgaaagccugcaacuggaagaaguauaaguucaucguucucaacagccucaaucagaaugccaaacccgagggcucugagcaggcagagcugggucgccucuccccucgagccuacccugcaccgcccgcuugccagccgccuauggagcccgcgaaccuugaucuccaguccccgaccaagcucagugccaguggggaggacucuaccaucccccaagccagccggcucaauaaucucgugaacaggucccugggaggcuccccccgaagcagcagugagagucacucaccacucuacaugcaccccccaaagugcacauccugcggcucucaguccccacagcauacagagaugugccuccauacugcugggcccacguucccggaggagaugggggaaacccagucagaguauucggauucuagcugugagaaugggaccuucuucugcaacgaaugugacugccguuucucugaggaggccucgcucaagaggcacacgcugcagacgcacagugacaaaccauacaaaugugaucgcugccaggccuccuuccgcuacaagggcaaccucgccagccacaagacuguccacacgggugagaaacccuaucgcuguaacauuuguggagcgcaguucaaucggccagccaaccugaagacccacacucgaauucacucuggagaaaagcccuacaaaugugaaaccuguggggccagguuuguucagguggcccaccuccgugcccacgugcucauccacacuggagagaagccguaccccugugaaaucuguggcacucgcuuccggcaccuucagacucugaagagccaucugcgcauccacacaggagagaaaccuuaccauugugagaaguguaaccugcacuuucgucacaaaagccaacugcgacuucauuugcgccagaagcacggcgccaucaccaacaccaaggugcaauaccgcgugucggccgcugaccugccuccggagcuccccaaagccugcugaaugaagcauggaguguuccucgcccuuuccucuccagccccuucucagaaucuacccaaaggaugcuguaacacuuuauacaaaggucaucccaugauguagugccucucucauccacuagugcaaaucauaguugggguggggguggg

SEQ ID NO: 148 - RNA, 989 nt, Homo sapiens
ucgcgguccgacggaggagugggcgcugggaucucgcugagcguccgccuggccucgucucuuccucgcucgucggagcuucagcacgguccgagauggcuggcgguaaggcuggaaaggacuccggaaaggccaagacaaaggcgguuucccgcucgcagcgagccggcuugcaguucccugugggccguauucaucgacaccugaaaucuaggacaaccagccacggacgugugggcgcgaccgccgcuguguacagcgcagccauccuggaguaccucaccgcagagguacuugaguuggcaggaaaugcgucaaaagacuuaaagguaaagcguaucaccccucgucacuugcagcuugcuauacguggagaugaagaauuggauucucugaucaaagcuaccauugcuggugguggugucaucccacacauccacaaaucgcugaucgggaagaaaggacaacagaagacuguuuaaggaugccuggauuccuuauuaucucaggacucuaaauauuccuaacagcuguccaguguuggugauuccaguggacuguaucucugugaaaaacacaauuuugccuuuuuguaauucuauuugagcaaguuggaggcuuaauuagccuuccaaccaaccaaauuucugcauucgagucuuaaccauauuuaaguguuacuguggcuucaaagaagcuauugauucugaaguaguggguuuugauugaguugacuguuuuuaaaaaacuguuuggauuuuaauugugaugcagaaguuauaguaacaagcauuugguuuuguacagacauuguuuccacucugguggauaagcucaauaaaggucauaucccaaacuagcuuuaaacuugcuuaauaaucgggucuuaccuuagaucucacucagcaacaaguacauucucugcuuacuaauuaaacagugcaucuguagucauaaaaaaaaaaaaaaaaaaaaaaaaaaaaaaaaaa

SEQ ID NO: 149 - RNA, 6342 nt, Homo sapiens
  misc_feature (439)..(538): n is a, c, g, or u
  misc_feature (1133)..(1232): n is a, c, g, or u
  misc_feature (1698)..(1797): n is a, c, g, or u
  misc_feature (2105)..(2204): n is a, c, g, or u
  misc_feature (2861)..(2960): n is a, c, g, or u
  misc_feature (3546)..(3645): n is a, c, g, or u
  misc_feature (4057)..(4156): n is a, c, g, or u
  misc_feature (4736)..(4835): n is a, c, g, or u
  misc_feature (5487)..(5586): n is a, c, g, or u
caccaccgugcacgcagcuccgggcccgugggguguugguucuugcccucguaacccccucuguccagccaccaugauaagcgccagcagagccgcggccgcgcgucucgugggcaccgcugcgucccggagccccgcagccgcccguccccaggugagaagcugccaugccuuccggugggggcuccaggcccggacucgagugaggcaggccuugccuucgggucagacucuaggaaaaauccggagcgaagggauguaacggaccuucugugggcauuguuggccuucuugcagggcuuuagcuucgaacugugcugagucacaauccuuggcguuccuaagucuuuaccccgcuaauugagacgucuguccccccucuaaccugugcgcuuugaaugugccuggacuuaggcaguggacguaguuuacuggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnuuuuacauacuaaggacuaaagcuugcauguguuccucagaauaugaaaagcccaaguucuuguguaguugauggcugaugcaacuuuuuuccccccaggauggcuggaauggccuuagccaugaggcuuuuagauuuguuucaagaagagauuaugcguaaguacaaccucaguuucucugagaaaaaaaaaaaacacuuauugaaccucaaagcuuggauggguugggugcguuauacauuuguacuuguaguuuauucaauaugccacugguaacaccaacauaaaacacaguucuucguauuggagaccacuguucagaugaccauggaauuucauuucuuacagaucagaagcaaucaagggugcagugguugguauugauuuggguacuacuaacuccuguguggcuguuauggagggcaaacaagcaaaggugagcaugauuggaaaccugaggucacuuagauacccagucuggcauuaaguacauaggaaugcugagucggagcccagguuaguggugggcacuuuaauccuaguaaaggcagagggaucucugaguucaggaccagccuagaguacaaagugagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacuuuaaucagugucuuugggaauuuuagguccuggagaaugcugaaggugccagaacuaccccuucugugguugccuuuacagcagauggagaacgacuuguugguaugccagcaaaacggcaagcugucaccaauccaaacaauaccuucuaugcuacuaagcgucuuauuggacgacgauaugaugacccugaaguacagaaagacacgugaguaauaggaaaaucaguccagaagacuggugcuuugaucaaaguucuguggauaccuugaguucuguggaucaccuuggaucacuuuuucauuauuucugcuugggaagaaaucacaccaccaucagaggcauauagguuuuuuuuuuguuauuucuuuguuguuguuguuuuccuauuuauuuguuuguuuguuuggggggggguuucuuuguguauuuuccuggaacucauucuguagaccaggcuggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnucaugugauauaugaugaacuuagagugguuaaguuucacagggauaguuuacuuacauaaucuuucugucuuuaaguaagaauguuccuuuuaaaauuguccgugccuccaauggugaugcuuggguugaggcucauggaaaacucuauucuccaagucagauuggagcauuuguguugaugaagaugaaagagacugcagguaaguggauuuauuucacauuuaggaaaauuggaaugugcuguuuauuucucugcauuaauacugauuaacuucauauucuguagauaauggagucugaagcuunnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaauucaugcuccuccugcugccuccugggugcuaaguugcaaggugauagcucagguacucacucuagugucuuucuuggggugcucuuuuccaaggccucucuacauauuaagccacaaaggagucuguugccccucaagaggaugagauguggaauauuaggcuacaguuuuguugccuuuuuuuuauuuuccuaacaugguaccacaauugaauuuuauucuuuguuucccagaaaauuacuugggccacacagcaaaaaaugcugugaucacagucccugcuuauuucaaugauucacagcgacagguaaaauuagaucucuuguuugcugggaguggaggugggguaccugaguuaaaggauggaaagauagauuuauuucuacuuucucuaggccacuaaggaugcuggccagauaucugggcuaaaugugcuucgagugaucaaugagccuacagcugcugcucuagcuuacggucuggacaaaucugaagauaaaguguaaguuggucagaugacguagcauuaccugcauuuacagggguuguguguguguguguguguguguaauuuuacuacaauuuguguggguccguguguugugguacauuuguacauuuguacauggcauggauauggaugucaaagauunnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaccaguaguugguguguuacuaauuuuacuuguuucuguaugacaugcuuauaugauacguuaacaggcaugccacuuagguugauaacuacauucaguuauuaaguauuucaggaaauaucauaguuaauaauuaaacuuuuggucuuuuaauucguuccuuuguuuuguuccuuggaacuuaacuuacuuauuuauuuuuuagcauugcuguguaugauuuaggugguggaaccuuugacauuucuauccuggaaauucagaaaggaguguuugaggugaaaucuaccaauggggacacuuucuuaggaggggaagacuuugaccaagcuuuguugcggcacauugucaaggaguucaagagagagguuaguuaccacugcuuagucaccacugguuaagguguaggcguuggguuguugagaauuuuuguuuguuugcauugcuuuuagcuuuguuaauagcuuuuuuauacuaagguaacuaacuauacuucagauucauggguaaacuaaaccaguuuaguuauauaaucuuagauugggaacaaaagaccaagugacaguguuauaguagggagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacuacucucucgcagucuauauaugucuccuaauccuauuuauagacagggguugauuugaccaaagacaacauggcgcuucagaggguucgggaagcugcugagaaggcuaaaugugaacuuuccucaucugugcaggugagggauggaaaaaucccaguacugagcauauuugaauaguguauucuaauuuaccuaaugucaguguagcucuuuacaguuuucuguuggcugaaaacuuggggcaugagcaaaggaacaacuugaugaucaguucuuuucauuugaaugaaugaaguagauuuauggauguguguaucuuuugccugcaugugugucuguacuacauuugugcuugguuucuguggcggccagaagaggguaucagaacugacaugucaguguuggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacugagucuaaauucugaucaugucuuucagucguguuauguuacuuugagugaguaucaaagaucacgucucccaucugacgugugguccugugcagacugacaucaacuugccauaccuuaccauggaugcuucuggaccaaagcauuugaauaugaagcugacucgagcucaguuugaaggcauugucacagaucuaaucaagagaacuauugcuccgugucagaaagcuaugcaggaugcagaagucagcaagagugacauaggagaagugauucugguugguggcaugacaaggaugcccaagguauggacucaugguauuucuccuagaggaaaaaaauaacaaugcauucuugaggcaaauggcuuguguuguguguggaaacaaaugugauccauucuucuaguguucuuuaaagaguggugagaccagacucaccaaaaagugcuuuuagucgccugugauggcucauguaggaggauggccuugaguucuggguaagaugcagcuacagaauucuaccuugcacacacacuuaaacccagucugguaaagagaaguuguuaagcuunnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagauguaaaauugauaauacuucuuccuaagauugggcgauuguguagaauaugagaacuguauuuuauaaccccuugucaugugccuucuauuucaaaugauauccucugggaagcuagauaauuaaauucuucucucauuuaaguggacaguggaugagaugcucugaaguugucaaauacaaacaagucugcagucuuggauaugaaucucucugacuugcugucuggcaggcguauucuguuuggcuccaucagucgcccuggguguuggcuaacagguucuuucucccugaugcuuagguucagcagacuguacaagaucuuuuuggcagagccccgaguaaagcuguuaauccugaugaggcuguagccaucggagcugccauccagggagguguguuggcuggugacguuacagacgugcugcuccuggaugucacuccccucucucuggguauugagacucugggaggcgucuuuaccaaacuuauuaauaggaacaccacuauuccaaccaaaaagagccagguaagagccauucuuuuuuccugccuauuaacagucccaaguuguacaagugcuguuuacaaucacuuuaugaacucuuuaaaacuuuguuucuaagacuauacuaacuggacugggugnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccuagguguuuucuacugcugcugauggacaaacucaaguagagauuaaagugugucagggggaacgagagauggcuggagacaacaaacuucuaggacaguucacuuugguaaguguuuuugagucugaguaucaugcuuuuggggucuauagcuugcaaagcuccaaacugcugacauuacaggcauauuguguuauuuuuuaaaaagaacguuauguacaugaguuaugaaacccaugauuuuaguuuuuuaccuaaagugcuuuguguuuucagaauuugaaauuuucaaagccugggaaauguucagacucagaagcaaugcuaacucagaaguuaguuuuauccugauuacucauuuuaaaaaacuuaauagcuacugguucuggucagcauugcuacaguagagaaguuuauuugcuguaaauucugggcacauauaaccaucaugguuauuaacuucuugaagcccagugauuucagaaagcacuaaaacuaccaccaucacuuaaaaucucaagguuuugaacauucagugaagauacuuguuuuaggaaacaagugguuaguuggccugauuuggaaaugagaauacaugggccuuucaaaggagcucacucuggauauuuauuuuagauuggaauucccccagccccucguggagugccccagauugaaguuacauuugacauugaugccaaugggauugugcacguuucugccaaagauaaaggcacuggucgugagcaacaga

SEQ ID NO: 150 - RNA, 4145 nt, Homo sapiens
  misc_feature (4045)..(4045): n is a, c, g, or u
auaaauucuuauuuugacacucaccaaaauagucaccuggaaaacccgcuuuuugugacaaaguacagaaggcuuggucacauuuaaaucacugagaacuagagagaaauacuaucgcaaacuguaauagacauuacauccauaaaaguuuccccaguccuuauuguaauauugcacagugcaauugcuacauggcaaacuaguguagcauagaagucaaagcaaaaacaaaccaaagaaaggagccacaagaguaaaacuguucaacaguuaauaguucaaacuaagccauugaaucuaucauugggaucguuaaaaugaaucuuccuacaccuugcaguguaugauuuaacuuuuacagaacacaagccaaguuuaaaaucagcaguagagauauuaaaaugaaaagguuugcuaauagaguaacauuaaauacccugaaggaaaaaaaaccuaaauaucaaaauaacugauuaaaauucacuugcaaauuagcacacgaauaugcaacuuggaaaucaugcaguguuuuauuuaagaaaacauaaaacaaaacuauuaaaauaguuuuagaggggguaaaauccagguccucugccaggaugcuaaaauuagacuucaggggaauuuugaagucuucaauuuugaaaccuauuaaaaagcccaugauuacaguuaauuaagagcagugcacgcaacagugacacgccuuuagagagcauuacuguguaugaacauguuggcugcuaccagccacagucaauuuaacaaggcugcucagucaugaacuuaauacagagagagcacgccuaggcagcaagcacagcuugcugggccacuuuccucccugucgugacacaaucaauccguguacuugguguaucugaagcgcacgcugcaccgcggcacugcccggcggguuucugggcggggagcgauccccgcgucgccccccgugaaaccgacagagccuggacuuucaggagguacagcggcggucugaaggggaucugggaucuugcagagggaacuugcaucgaaacuugggcaguucuccgaaccggagacuaagcuuccccgagcagcgcacuuuggagacguguccggucuacuccggacucgcaucucauuccacucggccauagccuuggcuucccggcgaccucagcguggucacaggggccccccugugcccagggaaauguuucaagcuuuucccggagacuacgacuccggcucccgguguagcucaucacccuccgccgagucucaguaccugucuucgguggacuccuucggcaguccacccaccgccgccgccucccaggagugcgccggucucggggaaaugcccggcuccuucgugccaacggucaccgcaaucacaaccagccaggaucuucaguggcucgugcaacccacccucaucucuuccauggcccagucccaggggcagccacuggccucccagccuccagcuguugacccuuaugacaugccaggaaccagcuacucaaccccaggccugagugccuacagcacuggcggggcaagcggaaguggugggccuucaaccagcacaaccaccaguggaccugugucugcccguccagccagagccaggccuagaagaccccgagaagagacacuuaccccagaagaagaagaaaagcgaaggguucgcagagagcggaacaagcuggcugcagcuaagugcaggaaccgucggagggagcugacagaucgacuucaggcggaaacugaucagcuugaagaggaaaaggcagagcuggagucggagaucgccgagcugcaaaaagagaaggaacgccuggaguuuguccugguggcccacaaaccgggcugcaagauccccuacgaagaggggccggggccaggcccgcuggccgaggugagagauuugccagggucaacauccgcuaaggaagacggcuucggcuggcugcugccgcccccuccaccacccccccugcccuuccagagcagccgagacgcaccccccaaccugacggcuucucucuuuacacacagugaaguucaaguccucggcgaccccuuccccguuguuagcccuucguacacuuccucguuuguccucaccugcccggaggucuccgcguucgccggcgcccaacgcaccagcggcagcgagcagccguccgacccgcugaacucgcccucccuucuugcucuguaaacucuuuagacaaacaaaacaaacaaacccgcaaggaacaaggaggaggaagaugaggaggagaggggaggaagcaguccggggguguguguguggacccuuugacucuucugucugaccaccugccgccucugccaucggacaugacggaaggaccuccuuuguguuuugugcuccgucucugguuuucugugccccggcgagaccggagagcuggugacuuuggggacaggggguggggcggggauggacaccccuccugcauaucuuuguccuguuacuucaacccaacuucuggggauagauggcuggcuggguggguaggguggggugcaacgcccaccuuuggcgucuugcgugaggcuggaggggaaagggugcugaguguggggugcaggguggguugaggucgagcuggcaugcaccuccagagagacccaacgaggaaaugacagcaccguccuguccuucuuuucccccacccacccauccacccucaagggugcagggugaccaagauagcucuguuuugcucccucgggccuuagcugauuaacuuaacauuuccaagagguuacaaccuccuccuggacgaauugagcccccgacugagggaagucgaugcccccuuugggagucugcuaaccccacuucccgcugauuccaaaaugugaaccccuaucugacugcucagucuuucccuccugggaaaacuggcucagguuggauuuuuuuccucgucugcuacagagcccccucccaacucaggcccgcucccaccccugugcaguauuaugcuaugucccucucacccucacccccaccccaggcgcccuuggccguccucguugggccuuacugguuuugggcagcagggggcgcugcgacgcccaucuugcuggagcgcuuuauacugugaaugaguggucggauugcugggugcgccggaugggauugacccccagcccuccaaaacuuucccugggccuccccuucuuccacuugcuuccucccuccccuugacagggaguuagacucgaaaggaugaccacgacgcaucccgguggccuucuugcucaggccccagacuuuuucucuuuaaguccuucgccuuccccagccuaggacgccaacuucuccccacccugggagccccgcauccucucacagaggucgaggcaauuuucagagaaguuuucagggcugaggcuuuggcuccccuauccucgauauuugaauccccaaauauuuuuggacuagcauacuuaagagggggcugaguucccacuaucccacuccauccaauuccuucagucccaaagacgaguucugucccuucccuccagcuuucaccucgugagaaucccacgagucagauuucuauuuuuuaauauuggggagaugggcccuaccgcccgucccccgugcugcauggaacauuccauacccuguccugggcccuagguuccaaaccuaaucccaaaccccacccccagcuauuuaucccuuuccugguucccaaaaagcacuuauaucuauuauguauaaauaaauauauuauauaugagugugcgugugugugcgugugcgugcgugcgugcgugcgugcgagcuuccuuguuuucaagugugcuguggaguucaaaaucgcuucuggggauuugagucagacuuucuggcugucccuuuuugucaccuuuuuguuguugucucggcuccucuggcuguuggagacagucccggccucucccuuuauccuuucucaagucugucucgcucagaccacuuccaacaugucuccacucucaaugacucugaucuccggunugucuguuaauucuggauuugucggggacaugcaauuuuacuucuguaaguaagugugacugggugguagauuuuuuacaaucuauaucguugagaauuc

SEQ ID NO: 151 - RNA, 1756 nt, Homo sapiens
caccugauucccggaggcccgagcccuuagucugggcgggguggcgcgggccggaaggacgccaucccggccugggccauggaggcucccgcaccgucccucacggaggaggauuugacugaagugaagaaggacgcuuuagagaauuuacguguuuaccugugugagaaaaucauagcugagagacauuuugaucaucuacgugcaaaaaaaauacuaaguagagaagacacugaagaaauuucuugccgaacuucaaguagaaaacgggcugggaaguuguuagacuacuuacaggagaaccccaggggccuggacacccugguggaauccauccgcagggagaaaacacagagcuuccugauucagaagauaacggaugaggugcuaaagcuucggaauauaaaacuggagcaccucaaaggccugaagugcagcagcugugagcccuuugcagccggagccaccaacaaccucucuaggugcaauuccgaugagagcaaucucucugagaaacagagagcauccacugucauguaccacccggagggagaguccagcacggcucccuucuucucuauggcgucgucccugaacuugccaguccuggaaguuggcaggacugaaaacagcagcuucucuucagccacucuuccucgaccuggggacccuggggcucccccuuugcccccagaccuucgguuggaagaggggggaaguuguggaaacucaagugagauguuucuccccuuacggucacgggcucuuucacgccaaugauacaucaccgccuaguuguuuuacuagugaugcaaaaugcugugaaggaggccaucuuucuauacaaaccacggugacaggucacucacauucgaugcgugccuuuaaaaucaguguacacauucucuguaaauaggauuuguuaggguaaagaagcgcucuggggcggcgugguguaaucaugguggucgugacuuuuccauaauguccuuucuuuuuuauuauuuuuagguguuugcguauuuugaacuuuucauaagauuaauuuuaucggaauauuucucaauuugagaaaacaacuuguggauugggaauaauguuuuuagcacauuuaugcuacaaauuuucagucugauuguuuuucccacugaucuggcaguauauuuuagcaguaagcuguugugugucaggaaagcuggacacgggaaagcugccgacacacucagcagugucccacuccuuaguucugagaagccgucggguucugaggagacaccugguggcacugagccuggugaccucagugggccaaaauuuguuuuauacucacccugccagcgugagugucuuacuuucacaggccuuguguccucagucuuaucuuaaaggauguuaucuuggcagggcaucacuuguaauuaauggaugauacuuguaauugacuaaaguccucgcucugagccguuuguucuggcuccgagagcgcugacaugugaagcauggugagcagcgagggaacugacaggauguggccguggccaguguggcuuuaguguuugcaucaggcagccaccagcuccauccguguucuuacugcuuuacaaaguuugacuaacuuuacacauuuuaaaaaugcugauugucuucguuuaaauuauaauuuuaccuauuucuugacaucuaacuccuauuuauuucuauuauuuaaaaauuaagaaaugaaaauuugcuauuaacaauaaaguuuuuuuaaugu

SEQ ID NO: 152 - RNA, 1113 nt, Homo sapiens
ggggggggggggucagcgccgacguccccugccgccaccaugcccaaaagaaaggcugaaggggaugcuaaaggagacaaaaccaaggugaaggacgagccacagagaagaucugcaagguugucugcuaaaccugcuccuccaaagccagagcccaaaccuaaaaaggccccugcgaagaagggagagaagguacccaaggggaagaaggggaaagcugacgccgggaaggaugcgaauaauccugcagaaaauggagaugccaaaacagaccaggcacagaaagcugaaggugcuggagaugccaagugaugugugugcauuuuugauaacuguguacuucuggugacuguacaguuugaaauacuauuuuuuaucaaguuuuauaaaaaugcagaauuucguuuuacuuuuuuuuuuuuuuuaagcuauauuguuagcacacagaacacuucauuacugggugggggaaggaucaugugucaguaacaaaaucucucccaagcuggauugaggacagaaaaccucuuucccugauaauuuuggaaggcuccuguuggcucccaggagagagauccuggucuugaccuagguggccaccaaggcacaacaaugccuuguggucugggaaaacuauaaauucacuuuuauauccucuucccccuguacuaucaacauagacuuaauucccuuaaaaaccagagaccuguuggaaccuggcccccaaaauugguuucccaguccauugagugauggggacuuugcagugacuucauugaguguucucaaaagagcacugguuccuuuuauaaaagauuguggaucuucagauugauaauucugccuaaaagucagggucggcuugugaaaaguuguuaaaacaacauccuuaaugugaaaugucaacccucacucuaagcuacuucccccuuuucaaagcauugaaugaagacuucauuggguuuuauaguggcuuucugauuuugguagucauaucagaagggaauuuggaaguucuuguauauuguugcauugucugcccauguccugccugaauaccaugauuguuuaugaaagaaucuuaauaaagcugguuacaguuaggcuggaaaa

SEQ ID NO: 153 - RNA, 321 nt, Homo sapiens
uuuuuuuuuuuuuuuuuggaaguccauaaguaguuuauugucuucaagacuacaguguggauuccucucccagagaagggucuuucagaggcaggggacugucacccaggugcaggccgucuacuugucauuuucauacauggcuggauucuuccuuuucgacugcucaaacuccugguugccccauguguagaucagguagaccacuacaaacggcggcgccacgcgcaggaugcgcucgcgagugcggcgcaacacguuggggaugccuuugcugaaauagcuugggaaggcgcgcugcucaaagggcgacaagcugua

SEQ ID NO: 154 - RNA, 1720 nt, Homo sapiens
  misc_feature (952)..(952): n is a, c, g, or u
caugaagccagagauguggaagaugugucuagacugcaucaaugaacugauggauacguuggaugcacauuccaacaucucugucggagagaacauuuuggcagagagugagaacuuacacaacuuugaucaguucacuccguguacgacgcugcauccuaacuuugguggagcgaauggaugaagaauuuaccaaaauaaugcaaaauacugauccucacucccaagaguauguggagcaccugaaggaugaggcacaagugugugcaucauugagcgagugcagcgcuaccuggaggagaaagguaccacugaggagaucugccagaucuacuuaaggcgcauccugcacacguacuacaaguuugacuacaaggcccaucagcggcacguuacuccuccugaaggauccucaaagucugagcaagaccaggcagaaaaugagggugaggacucagcugugcuaauggaaagacugugcaaguacaucuaugccaaggaccguacagaccggauccguaccugugccauccucugccauaucuaccaucaugcgcuccacucccgcugguaucaggcccgugaccucaugcucaugagccaccuacaggacaacauucagcacgcagacccgccggugcagauccuguauaaccguacuauggugcaacugggcaucugugcuuuccgccaaggccugacaaaggaugcacacaauggcacuucuggauauucagucaagugguggugccaaggagcuucuaggucaggguuugcugcugcgcgcuugcaggagcgaaaucaggaacaggaaaagguagagcgacgccggcaggugcccuuucaccugcacaucaaccuggagcugcuggagugugucuaucuggugucagcuaugcuccuggagauccccuacauggcugcccaugagagcgaugcccgccgacgcaunaucagcaagcaguuccaccaccaacugcgggugggcgagcggcacgcccugcuagguccucccgagucaaugagggagcauguggucgcugccuccaaggccaugaagaugggcgacuggaagaccugccacaguuucaucauuaaugaaaagaugaaugggaaagugugggaccuuuucccugaggcugacaaaguucgcaccaugcuaguucggaagauccaggaagagucucugaggaccuaccuuuuuaccuacagcagugucuaugacucaaucaguauggagacacuaucagauauguuugagcuggaucuacccacuguucacuccaucaucagcaagaugaucauuaacgaagaauugauggcuucccuggaccagccgacacagacuguggugaugcaccguacugagcccucugcccagcaagaaacuuggcucugcaagcuggcugagaaaacuuggcacccuaguggagaauaauggacggguguuugaccaaaaacagggaaccuaugguggcuauuuccgagaccccaaggguggcuaccggaaaaauggaggcuaaaugccccgugguggcuacccccagcaacagucucagacaaccuccugaguuccccacuucagucacccuguggacagaccaucuaaccuuuuucuccuaacucaccccaaucauuaaagaucuuuugaggaauuaaaaaaaaagaaagaaaaaaaaaaaaaaaaaaaaaaaaaaaaaaaaaaaaaaaaaaaaaaaaa

SEQ ID NO: 155 - RNA, 453 nt, Homo sapiens
uuauuaauuaaaaaacaauuuauugaaaaagaguagugcuuuguacaaauucccauugcagcccccagauaucaacugaucucuuuccagcuuugguaguaggguauaaaaauaucaaaacuagguaaguucugauguaagauuucuaugggauuauuuuagaauauauagauuuguguaguuuggcaaguaucauuucuaugcauuuacauuacauauuaagcacagauucuguggcaaaacaucuuugcaugauuacuuuacacacacaaauauaguaaaacuuacauaguacaaauucacauaagacuccauucugucuauaacuucauccaugugguuuuaccaugaauuauaauucuuaaccucuccuauaacugucagcuuccauuuaauuuugaaaguaucacuucacaaagagcacuucauuugcuuuuagaguauacauagacu

SEQ ID NO: 156 - RNA, 361 nt, Homo sapiens
  misc_feature (230)..(230): n is a, c, g, or u
cggccgccaagaaguauaacaugcgaguggaagacuacgagccauaccccgaugauggcaugggguauggcgacuacccgaugcuccccaaccgaucacagcaugagagggauccgugguaucagugggaccacucagaacucaggaugaacuggggugaaccgauacacugggaccuagacauguacaucaggaaucguguggacacgucaccuaccccuguguccugngaugucauguguaaacaucucuucggcuuuguggcuuucaugguuuucauguucuggguagggcacguguucccuuccuaccagccuguggguccgaagcaguacccuuacaaaaaucuguaccuggagcg

SEQ ID NO: 157 - RNA, 452 nt, Homo sapiens
uuuuuuuuuuuuuuuuugaugcaaaugucuuuauuuuccacuuaaacaaguuucccuuuugcacuggccuguggcacaaaacagauggcuggguggugacauuaacugucaaguuagugagaugcagagauggugagacacugcauuugagugcauaauacuuuuauuccagaggaacgccaugcagcccaguuacaccuuuaggucagaaaggcugaugcgugaccagccucuauugccucccuugguaagaaggacccacaagugcagaguccaacagaugcuggcucugagcugaacucagggcauuccaauuaccacuuucuucuucaccuacacagggccugcucagauguccuuuuuacaacuccauaagcccuuuggccaaagucccugcaguguuuggggaggaccuucccacccuucaccagucagugucugaucugguggag

SEQ ID NO: 158 - RNA, 392 nt, Homo sapiens
uuuuuuuuuuuuuuuuuaauaucuguaauaguuuauuucaaagauuugacauuuacaaguagaggcaccacaugcuaucugacaguaaaauacugcagggacugaaggccaaggagagagauccacagaagacaggccuguagugcaggcauugcaucgaccuugcccacagugcuuuguucccaacucaggacaguacuuuagugcuugcuucauuuacuggaaaaguucacuggacauaguuuccacuucuucccccacagcuuccagcucagcaaacuuaagcuacuacuccucgaugcucucauagaggcucuugauuugugucuggaagaacuuggcaagcucuacucguuuggcuuucagugucggugucagaaguccguuuucaa

SEQ ID NO: 159 - RNA, 217 nt, Homo sapiens
uuuuuuuuuuuuuuuuucugagguauuaaaauaucuagacugaauuuugccaaauguaagagggagaaaguuccugaagacucugacuacuugcuuauuuuugauugaccuucuaugcuuaugucauuacugccucacaacguguuugauguccuuuaaugauacaaagugagccugugccuucauuuucuugcccauuuugguaccccucgugccg

SEQ ID NO: 160 - RNA, 1515 nt, Homo sapiens
gcgcccgaacgucuagcagaguaccugcugcuguaagcuugucgucugggcugcaccgcccgucuuaacccauucucgacuuaacuacucucgucgaacaagcauggaaguacagaaagaagcgcagcgcaucaugacucugucgguauggaagauguaccacucucgcaugcagcgagguggcuugcgacuccaccggagucugcagcuaucccucguuaugcgcagcgcucgagagcucuaccucucagccaagguagaagcccaccagcccgaguucccgccaucccgcagggcucuugacccucgccugcacccgccgcgggaagccgaaguugcaguggaaguagcgucccccgaagccgugcagccuccggagcccauggauacgcaagaggaagugcugcgaguccaggagaccccugcgcucugugacccgccccccgcuagagucagccgcaagcgccggagcagcagcgauuugagcgacaguagugaugccggacugguaccaagcaagaaggcccgucuagaagagguggagggggaggcgacgucggagguucccgaucgccugcagcuuccuccggcacaaagcgaaggugccuucccuaaccucgcccgcguccuccaaaggcgcuucuccagucuccugaacuguggacccgccgugcccccgccgacgccccccacgugcgaggccaagccagccugccgcccggccgacaauaugcucaacgugcuggugcgagcugugguggccuucugagagcucugguggcuucuuucgagcggcgccaccggagcggagaacgcacacccgaggcgaaggccggcgggggccgugaagaagagccgcggcccgagcugccgagaggccagggcaaggacugaggagcgaggggcgcgggcgccuucucccagacgugcguccauaggugcuauuaaaggacugucccuuccuuggcuuggagaagggacaccuagaucuugaaucucagggucgaacucucuaggggccaggcugcccuuucaaggccguuucacuaccauucgcguuucggccccuacaagugggcacgcuugugcaagcggucagaguugcgucaugggacagacgcgggugcuuccuguugccuugcguggguguggggccugggaggaggccaggguguggacccgcccuagggacugggaagugacuugagucaccucgcccccacaggcugcugugggugagccugaacugaaccaaucaaaucugcgcagaguugaaguggcuggagaccccgggacuggucaaccuagaugaucgccuggcguggaccaccgcgggacgggugggccgcuggucguaguugcugccguagacacagcuucuucgggcaggaaagaaaauuuuuuuuuuaccagcguguuuaagaaagucuguuuacuuuucccacgguggguuguuuaauuagcaacuaccuggaguuuuacaaugucagcuaggaaaauaaagaccaucggugu

SEQ ID NO: 161 - RNA, 801 nt, Homo sapiens; identical to SEQ ID NO: 81

SEQ ID NO: 162 - RNA, 447 nt, Homo sapiens
uuuuuuuuuuuuuuuuugguuccacuuaaguugcauguuuuauuucucccaaucccagcaauagcacagaagcccaucauguccaucccagacugguuucuaguaggcugagaugacagggagccucaguaacgcuaauggcacagagggcucccaaaugccaggcacaacugugccuccacacuggugacugcccagagugcccuggccccaguguguuggcacucagucugacuuuacaacgcaaccugcaccuuugaaagggacagucugggaguggggagugugagggagugaagcucaaacugccuccugucagcucacccuuucaacauuaaacagagaccaagagagaaacaguuccaauauuucacauauauuucuucuugugcagucuaagccgagaaugccauguaaaugggucacugcgaaaugcagcaauuuagu

SEQ ID NO: 163 - RNA, 475 nt, Homo sapiens
gucucgggcgagauggcuucaagguuacuucgcggagugggcgcuuuggcggcgcaggcccugaggcgcacggcccguggcgcggccgugacccgcuccauggcuucuggaggugguguccccacugaugaggagcaggcuacugggcuggagagggagaucaugauagcagcacagaagggacuggacccauacaauaugcuaccuccaaaggcagcuucaggcaccaaggaagacccuaaucuagucccguccaucagcaacaagagaauagugggcugcaucugugaagaggacaacuguacugucaucugguuuuggcugcacaaaggcgagagucagcgaugccccaacuguggaacccauuacaagcuggugccccaccaaauggcccacugagccccuguguuaucuuuucagaauguaaagaaaaacuucucucuaauaaagacuagccauugcaccugcuccuccc

SEQ ID NO: 164 - RNA, 1897 nt, Homo sapiens; identical to SEQ ID NO: 30

SEQ ID NO: 165 - RNA, 2167 nt, Homo sapiens
gcgcaccgccygyguygcgcgscagcgucgucuaggugcaucgcgggcccccgcagrwagaaaaauauggcucaggagacuaaccagaccccagggcccaugcuguguaguacaggauguggcuuuuaugggaauccuaggacaaauggaauguguucuguuugcuacaaagaacaucuucagagacagcagaauaguggcagaaugagcccaauggggacagcuagugguuccaacaguccuaccucagauucugcaucuguacagagagcagaugcugguuuaaacaacugugaaggugcugcuggcagcacaucugaaaaaucaagaaaugugccuguggcugccuugccuguaacucaacaaaugacagaaaugagcauuucaagagaggacaaaauaacuaccccgaaaacagaggugucagagccaguugucacucagcccaguccaucaguuucucagcccaguucuucucaaagugaagaaaaagcuccugaguugcccaaaccaaagaagaacagauguuuuauguguagaaagaaaguuggccuuacaggguuugacugccgauguggaaauuuguuuuguggacuucaccguuacucugacaagcacaacuguccauaugauuacaaagcagaagcugcagcaaaaaucagaaaagaaaauccaguuguuguggcugaaaaaauccagagaauauaaaauuacuacaugugaagagacugaaacuuuguuuuuauuuuaauauaucguaggaaaacauuaaagagcagaugcauggccauuuuccuuugauguucuccagaguuuugcuuuauacuugucugucauauaauugaucuuuuaggauguuuggguguuuguuacaggcagaauuggauagauacagcccuacaaauguauaugcccuccccucaguaaaauuggacaaaaauaugcacaacaaauugaaauacacauauacuaggaacaaaauuuaguuccacgugccaaacuaaaggaaugaaaucucugcauguuugcagcauaucugccuuuugggaauguaaucaagguauaaucuuuggcuaguguuaugugccuguacuuaaaaaaaaaaaaaugguacaccagaaaaggacuggcagucuacuaccauagucaaacuucaccuuaauuucgacaugacuuuuggaagcaggaagaaagcuacaaaacugguauuugguaccaugugugagccugguuaaauuggucuucuaaaagcugucaauuaggacauucugcgaaagguaacaucacaacugguucuaagucaaaccaucaagucaacagcagggugccugagauaaucuuggaagcuuauugugcuggccugcaccagaagauaucugcauucucauuacuaaaauuguagcacagaacugcacuaggauuuguuuacaaggagaaauuaaacucuguuugguuuucacauauagcagcucuguuaaauaacaugcaucugaauuuuaaguugcaaagguaucugaacaguuaauuuuucaugugcaucuuuuguugaauguuuugguucaagaaagaauguuuaaagcuuuuuaaagacuucaguucuuaauguaacuguacccuucugcauggaaaaucauaaccaacauggcugcaguagacuucuuuagugguauccagcaccacuugcagagggcugcuuuaucauauuguacuuggguguaggacucuaguguucuuggguguauugcaugggcugcauuaucuacagcauuguacaauaacaacuagaaaaggcgguauacuucacugaugcuugucugguaauaucacuucuguguuaaaauggaagguuuuuugugauguaugaaacuuguguuuuuuauauauaaaugaguauaguuagauuaguguugugguaaugccuguuuucaucuguaaauaguuaaguauguacacaacaaggcacuacuucugauuuuugcaguguucaguccuaguuuuucuuuauuaaaacauugaguuuugcuucaauuuuauguaccuuaguucuaaguuagauuugcagauguguacagauaguucauauuuauguauugcacauaaucaugcuauucagcauugaugcuauauuguauuauguaaauaauaaaagcaguguacagagggaaaa

SEQ ID NO: 166 - RNA, 897 nt, Homo sapiens
augacagaugccgcuguguccuucgccaaggacuucuuggccgguggaguggccgcagccaucuccaagacagcgguagcacccaucgagagggucaagcugcugcugcaggugcagcaugccagcaagcaaaucacggcagauaagcaauacaagggcaucauagacugcgugguucguauccccaaggaacagggaguccuguccuucuggcgugggaaccuggccaaugucaucagauacuuccccacccaggcucucaacuuugccuucaaagauaaauacaagcagaucuuucugggugguguggacaagaggacccaguucuggcgcuacuuugcagggaaccuggcaucagguggugccgcuggggcuacauccuugugcuuuguguacccucuugauuuugcccguacccgucuagcagcugaugugggcaaagcuggagcugaaagggaauucaaaggccuuggugacugccugguuaagaucuacaaaucugaugggauuaagggccuguaccaaggcuuuaaugugucaguacagggcauuaucaucuaccgagcugccuacuuugguaucuaugacacugcaaagggaaugcucccagaucccaagaauacucacaucuucaucagcuggaugauugcacagucugucacugcugucgcuggccugacuuccuauccuuuugacacgguucgccgucguaugaugaugcagucuggacgcaaaggaacugauaucauguacacaggcacgcuugacugcuggcggaagaucgcgcgcgaugaagggagcaaggcuuuuuucaagggcgcaugguccaacguucucagaggcauggguggcgccuuugugcuugucuuguaugaugagaucaagaaauacacauaa

SEQ ID NO: 167 - RNA, 3873 nt, Homo sapiens
cguagaaguugucucugucggcgggcgggcgggcaggauuggggcaccgagaccggcgugcggacagcagggaucgcggggagcgaggggugcggcauggagcuccgggcagucgguuucugccuggcgcugcugugggguugcgcgcuggcggccgcggcggcacagggaaaggaaguuguuuuguuggacuucgcagcaaugaagggagagcucggcuggcucacgcaccccuauggcaaagggugggaccugaugcagaacaucauggacgacaugccuaucuacauguacucggugugcaacgugguauccggcgaccaggacaacuggcuccgcaccaacuggguguaccgggaggaggccgagcgcaucuuuauugagcucaaguucacggugcgagacuguaacagcuucccggguggcgcccaugccugcaaagagaccuucaaccucuacuaugcagagucagauguggacuauggcaccaacuuccagaagcgccaguucaccaagauugacaccaucgccccugacgagaucacggucagcagugacuucgaggcucgcaacgucaagcugaacguagaggagcgcaugguggggccccuuacccggaagggcuucuaccuggccuuccaggacaucggcgccugcgugcggcugcucuccguucgcgucuacuacaagaagugucccgagaugcugcagagcuuggccugcuuccccgagaccauugcugucgcuguuuccgauacacaaccccuggccacgguggccgguaccugcguggaccaugccguggugccuuaugggggcgagggggcucucaugcacugcacgguggauggcgaguggcuggugccauccgagugccugugccaggaaggcuacgagaaggucgaggaugccugccgagccuguucuccaggauucuucaagucugaggcaucugagagcccuucccuggaguguccagagcauacccugccauccacagagggugccaccuccugccagugugaagaaggcuauuucagggcaccugaggacccacuguccaugucuugcacacguccacccucugccccuaacuaccucacggcaugcaugggugccaaaguagaacugcguuggacagcucccaaggacacugguggccgccaggacauugucuacagugucacuugugaacagugcugcgcagagucuggcgagugugggcccugugaggccacggugcgcuauucagaaccuccucacgcccugacccgcacgagugugacagucagugaccuggagccccacaugaacuauaccuucgcugucgaagcacgcaauggcgucucaggccuggugacuagccgaagcuuccggacugccagcgucaguauuaaccaaacagagccccccaaagugaggcuggaggaccgaagcaccaccucccugagugucaccaggagcaucccggugucacagcagagccguguguggaaguacgaagucaccuaccgcaagaagggggaugccaacagcuauaauggccgccgcacggaaggcuucuccgugacccuggaugaccuugcuccggauaccacguaccuggugcaggugcaggcauggacgcaggagggccaaggagccggcagcaaagugcacgaguuccagacgcuguccacggaaggaucucgcaacauggcggugaucggcgguguggcuguagguguuguuuugcuucugguacuggcaggaguuggccucuucauccaucgaaggaggaggaaccugcgggcucgccaguccucugaggauguccguuuuuccaagucagaacaacuaaagccccugaagaccuauguggauccucacacuuacgaagaccccaaccaggcuguacucaaguuuaccaccgagauccacccauccuguguggcaaggcagaaggucauuggagcaggagaguuuggagaggucuauaaagggacgcugaaggcauccucggggaagaaggagauaccgguggccaucaagacacugaaagcgggcuacacugagaagcagcggguggacuuccugagcgaggccagcaucaugggccaguuuagccaccacaauaucauccgccuggaggcgguggucucuaaauacaaacccaugaugauuaucacagaguacauggagaauggagcgcuagacaaguuccuuagggagaaggauggugaguucagcguacuucaguuggugggcaugcugagggguaucgcauccggcaugaaguaccuggccaacaugaacuacgugcacagagaccuggcugcccgcaacauccucgucaacagcaaccuggugugcaagguguccgauuuuggccugucgcgugugcuggaggaugaccccgaggccaccuacaccacaaguggcggcaagaucccuauucgauggacagccccagaggccauuuccuaccgcaaguucaccucagccagcgauguguggagcuacggcauugucaugugggaagugaugacuuauggcgaacggcccuuacuggaacugucaaaccacgaggucaugaaagccaucaacgacggcuuccggcuccccacgcccauggacugcccuucagccauuuaccagcucaugaugcagugcuggcagcaagagcgcucccgccggcccaaguuugccgacaucguuagcauccuggacaagcucauccgacgccccgacucccucaagacgcuggcugacuucgauccccgaguguccauccggcugcccagcaccagcggcucggagggaguccccuuccguacgguguccgaguggcuggagagcaucaagaucgaacaguacacggaacacuucaugguggcuggcuacacggccaucgagaaggugguacagauguccaacgaagacaucaaaaggaucggagugcgucuuccuggccaccagaagcgcauugccuacagccugcugggacucaaggaccaggucaacacaguggggauuccuaucugaguccauuggggcugucacacaauacuugaagagccacaguggucucccugccgaucuggugcuggcccacuggaacuuuauuuauuucuguuuccucgucuaugccucccuaggacucugcaggggcuuuuugaaugacaccugccugagccugggaaacuuggauugcuggucagggcucucuuuccccugaaaaggacccagcuaagaacuuagcaguuugccauggccuucccagcauccccugaggcuaaaguuccaccaagagucgauaucgacgagggacauuuccaaacggaccuccccaucuucauuuggccuccugagaagccacucuggagcugaggcuaagcacuaagcccaggaccauaugacuagcacuguaccgcccgccccuaguuagaggguagguuuuggacuuggcuggguuguggucacaagcaaucucccagugccuuuuacagaccccagucugcccucccgucgagggccagcuucuugcuuuccuagggcccucucaggaugcuuggcugugcugagguuuuuauuaaauauauauuuuauacuugcggaaagaaugaguguguggcagggacuugccagggcuggagacagaggauccccugcaacaagacauucccgggcugggggcuggcggaccugcaggagacuuuccgccaccaccccgucuccagccccuuuggacaaaugucgcugucaguguuacagauuucuuuuauuggguuguuuuuuuguuguauuuuuuugaaccuuaacuuauuauuuuuuuuauauuuauuguuagaaaaugacuuauuucugcucuggaauaaaguugcagaugguuca

SEQ ID NO: 168 - RNA, 1591 nt, Homo sapiens
ccaaaaaccuuaauuuucuuucuuguucgguaccuacauuggaaccaccaaaaacaauuauuucaguaaaccguagccaugagggaaaucgugcacauccaggccggacaguguggcaaccagaucggugcuaaguucugggaggucauaagcgaugaacauggcaucgaccccaccgguaccuaccacggugacagcgaccugcagcuggaccgaaucucuguguacuauaaugaagccacagguggcaaguaugucccucgagcuaucuugguggaucuagaaccugggacuauggacuccguucgcucagguccuuuuggccagaucuucagaccagacaacuucguuuucggucagucuggggcaggcaacaacugggcuaaaggccacuacacagagggagcugaguugguugacucugucuuggauguggugcggaaggaggcggagagcugugauugccugcaaggcuuucagcugacccacucacuggguggaggcacuggcucuggcaugggcacccugcucaucagcaagauccgggaagaauauccugaccguaucaugaauaccuucaguguggugcccucgcccaaagucucugauaccguggucgagcccuacaaugccacccugucuguccaucaguugguugagaacacggaugagaccuacugcaucgacaacgaggcccucuacgacaucugcuuccguacccucaagcucaccacgccaaccuacggagaccugaaccaucucgucucggccaccaugagcggcgucaccaccugccuccguuucccgggccagcuuaaugcugaccuucgaaagcuggcugucaacauggugccauucccacgucuccacuucuucaugccuggcuuugccccucucaccagccguggaagccagcaguaccgggcccucacugugccugaacuuacccagcaggucuucgaugccaagaacaugauggccgccugcgacccgcgccacggccgguaccucacaguugccgccgucuuccguggacggauguccaugaaggagguggaugagcagaugcucaacgugcagaacaagaauagcagcuacuucguggaauggauccccaacaaugucaagacagcugucugugacaucccaccgcguggccucaagauggcagucaccuucauuggaaacagcacagccauccaggagcuguucaagcgcaucucugagcaguuuacggcuauguuccgccggaaggcuuuccuccacugguacacgggugagggcauggacgagauggaguucaccgaggcugagagcaacaugaacgaccuggugucugaguaccagcaguaccaggaugccaccgcggaagaggaagaggauuucggagaggaggcagaagaggaggccuaacggcagagagcccugcaucagcucaggcugcuuagaucccucagccuuucuccaacugcccuuuguccuccaguuucuuucugcugccucugucuuguauuuguuuugcuucuguuuucucauuggggguaaauggugccuggcacauggcaggcacucaauaaauauuuguuugugg

SEQ ID NO: 169 - RNA, 1992 nt, Homo sapiens
ggcagacaaaagaggccggcagugcagcucgcgggacgcauggccgggcgcggaggacgggugcugcuggcgcugugugccgcgcugguggccggcggguggcugcugacgcgugaagcccaggagcccggggcgccagcggcuggcaugaggcgccgccggcggcuccagcaagaggacggcaucuccuucgaguaccaccgcuauccagagcugcgcgaggcgcuggugucgguauggcugcagugcaccgccaucagcagaaucuacacagugggcgccagcuucgagggccgggagcuccuggucaucgagcugucugacaaccccgggguccaugagccgggugaaccugaauuuaaauacaucgggaacaugcauggcaaugaggcgguuggacgggaauugcucauuuucuuggcccaguaccuguguaacgaguaccagaaaggcaaugagacaauugucaaccugauccacagcacccgaauucauaucaugcccuccuugaaccccgacggcuuugagaaagccgcauggcagcccgggcagcugaaggacugguuugugggccgcagcaacgcccagggaauagaucugaaccguaacuucccagaccuggacaggaucguauauguuaaugagaaagaaggcggucccaacaaccaccugcugaagaaucugaagaaaauuguggaccaaaauucaaagcuugcccccgagaccaaggcugucauucacuggaucauggacauuccauuugugcuuucugccaaucugcacggaggagaccuuguggcuaauuacccauaugaugagacacggagcgguacugcucacgaauacaguuccugcccugaugacgcaauuuuccaaagcuuggcucgcgcguacucuucuuucaacccagucaugucugaccccaaucgaccucccugcugcaagaaugacgaugacagcagcuuugaugauggaacgaccaaugguggugcaugguacagcguccccgguggaaugcaagacuucaauuaccugagcagcagcaacugcuuugagaucacuguggagcuuacgugugagaaguucccaccugaagagacucucaaaagcuacugggaagauaacaaaaacucccucaucaacuaccuggagcagauacaccgagguguuaaaggguuuguccgugaccuucaggguaacccgaaugccaacgcaaccaucucuguggaugggauagaccaugaugucaccucggcuaaggauggggauuacuggcgauugcuugcuccuggaaacuauaaacuuacagccuccgauccuggcuaccuggcaaucacaaagaaaguggcaguuccuuuuagcccugcuguugggguggacuuugagcuugagucuuucucugaaaggaaggaggaggagaaggaagaauugauggagugguggaaaaugaugucagaaacuuugaauuuuuaagaaaggcuucuaacuaauugcuuucaucuaucuauagacuguaguaagaugcaauguggcucuuuucuuuuagguugugugcaguugauauuuaacauugauuuauuuuugaucauuaaguaauaguuacuaaucacguaaauacacccggacagaaauauaaugcuggacaucuucauucuacaucaacauucgcuuaaaucauucgaagccucuuuuaacguaaugggugacaaugucacuugacagaugcaugagagucacgauauagcugacugugacccugcacugcaaucacauaguuccauauaaguuguccuuagucucuugugcugauucacuguauaagcaugauccugguaaugcacuuuggaugggaagaaaauguacgugcuuuucagaggggcucugaacagaaugaaaaccuaguucuugcguguacuuugaagaauggaauuguauuagucagcuguuaaugccacuucagaaguuugggguuuugucuugauuguagauugg

SEQ ID NO: 170 - RNA, 1828 nt, Homo sapiens
gccacggacgccucucugaacggggauccaggcaggauuagagcugccucacugacuacaggccgugucgugucaccguuucugcaggcaccaugagccaggacaccgaaguggacaugaaagauguggagcugaacgagcuagaaccggagaagcagcccaugaaugcagcggacggggcggcggccggggagaagaacggucuggugaagaucaagguggcggaggacgagacggaggccggggucaaguucaccggcuuauccaaggaggagcuacugaagguagcgggcagcccuggcugggugcgcacccgcugggcgcugcugcugcucuucuggcucgguuggcugggcaugcuggcgggcgccgugguuaucaucguucgggcgccgcgcugccgugagcugccuguacagaggugguggcacaagggcgcccucuaccgcaucggcgaccuucaggccuuuguaggccgggaugcgggaggcauagcuggucugaagagccaucuggaguacuugagcacccugaaggugaagggccugguguuaggcccaauucacaagaaccagaaggaugaaaucaaugaaaccgaccugaaacagauuaaucccacuuugggcucccaggaagauuuuaaagaccuucuacaaagugccaagaaaaagagcauucacaucauuuuggaccucacucccaacuaccagggccagaaugcgugguuccucccugcucaggcugacauuguagccaccaaaaugaaggaagcucugaguucuuggcugcaggacgguguggaugguuuccaauuccgggaugugggaaagcugaugaaugcacccuuguacuuggcugaguggcagaauaucaccaagaacuuaagugaggacaggcuuuugauugcagggacugaguccucugaccugcagcaaauugucaacauacuugaauccaccagcgaccugcuguugaccagcuccuaccugucaaauuccacuuucacuggggagcguacugaaucccuagucacuagguuuuugaaugccacuggcagccaauggugcagcuggagugugucgcaagcaggacuccucgcagacuuuauaccggaccaucuucuccgacucuaccagcugcugcucuucacucugccagggacuccuguuuuuagcuacggggaugagcuuggccuucagggugcccuuccuggacagccugcgaaggccccacucaugccguggaaugaguccagcaucuuucacaucccaagaccuguaagccucaacaugacagugaagggccagaaugaagacccuggcucccuccuuacccaguuccggcggcugagugaccuucgggguaaggagcgcucucuguugcacggugacuuccaugcacugucuuccucaccugaccucuucuccuacauacgacacugggaccagaaugagcguuaccugguggugcucaacuuccgagauucgggccggucagccaggcuaggggccuccaaccucccugcuggcauaagccugccagccagcgcuaaacuuuugcuuaguaccgacagugcccggcaaagccgugaggaggacaccucccugaagcuggaaaaccugagccugaauccuuaugagggcuugcuguuacaguuccccuuuguggccugauccuuccuaugcagaaccuaccacccuccuuuguucuccccaggccuuuuggauucuagucuuccucuccuuguuuuuaaacuuuugcagauuacauacgaauucuuauacuggguguuuuugucuucaaauaaaaacaucaccccugccucaug

SEQ ID NO: 171 - RNA, 2610 nt, Homo sapiens
  misc_feature (2)..(2): n is a, c, g, or u
  misc_feature (11)..(11): n is a, c, g, or u
  misc_feature (26)..(26): n is a, c, g, or u
  misc_feature (41)..(41): n is a, c, g, or u
  misc_feature (45)..(45): n is a, c, g, or u
  misc_feature (56)..(56): n is a, c, g, or u
  misc_feature (70)..(70): n is a, c, g, or u
  misc_feature (2262)..(2262): n is a, c, g, or u
  misc_feature (2276)..(2276): n is a, c, g, or u
  misc_feature (2288)..(2288): n is a, c, g, or u
  misc_feature (2290)..(2290): n is a, c, g, or u
  misc_feature (2298)..(2298): n is a, c, g, or u
  misc_feature (2309)..(2309): n is a, c, g, or u
  misc_feature (2311)..(2311): n is a, c, g, or u
  misc_feature (2324)..(2324): n is a, c, g, or u
  misc_feature (2333)..(2333): n is a, c, g, or u
  misc_feature (2335)..(2335): n is a, c, g, or u
  misc_feature (2412)..(2412): n is a, c, g, or u
  misc_feature (2418)..(2418): n is a, c, g, or u
  misc_feature (2435)..(2435): n is a, c, g, or u
  misc_feature (2447)..(2447): n is a, c, g, or u
  misc_feature (2462)..(2462): n is a, c, g, or u
  misc_feature (2475)..(2475): n is a, c, g, or u
  misc_feature (2483)..(2483): n is a, c, g, or u
  misc_feature (2493)..(2493): n is a, c, g, or u
  misc_feature (2513)..(2513): n is a, c, g, or u
  misc_feature (2523)..(2523): n is a, c, g, or u
  misc_feature (2535)..(2535): n is a, c, g, or u
  misc_feature (2552)..(2552): n is a, c, g, or u
  misc_feature (2555)..(2555): n is a, c, g, or u
  misc_feature (2566)..(2566): n is a, c, g, or u
  misc_feature (2590)..(2590): n is a, c, g, or u
gncuuaagccncguuuauuuugaugnccuguuggcucagunaugnccaagaugccnauuguuuuugcccnaaauaaauuuacugaacuugggcuaaaaccaaaccuuggcacacaggugugauacaacuuaacaggaaucaucgauucauccauaaauaauauaaggaaaaacucaagugguagccugucuuaaggcuuuugauacuugcagauuggggaaaaacaaacaacaaacgucuugaagcauauuaauggaauuaguuucuaauguggcaaacuguauuaaguuaaaaguucugauuugcucacucuauccuggauagguauuuagaaccugauaauagucuuuaaacaagccauuccagucaugaugaggugauguauggauacaugcauacauucaaagcacuguucucaaaguuaaugcaaguaaauacagcaauuccucuuucaauguuuaggcagaucguuaacuaugagcuagccaaaugugggcauguuauuacagggaaaguuuaaaggucugauaacuugaaauagguuuaggagaauucaucuacuuagacuuuuuaaaugccugccauaaaaaauugaaaugguagaauggcugaccacagcaaugaccagcccucaccuagggcucuggaugauuuuuggucuaauaacgcaugcuaguguugauguuuuuuggucaagaugggaaugaacaggaagaauuaugcagcaggcuuuauuuuaaaugccgauucacauuacucuguucaagcugcguugagauguuaaacuggcuuacuauagacuuuguaaaaaaaaaaaaaaccaaacaaauggcuccagaagaguaacaaacugaaaucugagaucacacagguuggaaauauguacauaacugaacaaggugucaauucugcucuacagugcaguuuagucaguuuuaguugcauagguuuccauuguuuuuauagucuguuuaugcuaaaucuggccaaagaugagcauuguccaccacuaaaaugccuaugccacugggaauucuggguuaauuuugugaccagaaugcagugaucaaaauguucaaucuuuuuacaguggcauaggaagauggcaaaaauuuccuaaagugcaauagauuuucaaguguauugugccuuguucuaaaacuuuuauuaaguaggugcacuugacaguauugaggucauuuguuauggugcuauuucaauuagucuagguuuaggcccuuguacauuuggcccauaacuuuuuacaaaguacuucuuuuauugcacauucagagaauuuuauauauaugucuugugugcguguccuuaaacuuccaaucuuauuuugucucuuggagauuguugaacgcagcuugucuaggaaagggaugggacuagauucuaaaauuuauuugggaccaugggaaugauaguugggaagaaacuuugcacacgacagauuucuagauacuuuuugcugcuaguuuuauguaauauuuauugaacauuuugacaaauauuuauuuuuguaagccuaaaagugauucuuugaaaguuuaaagaaacuugaccaaaagacaguacaaaaacacuggcacuugaauguugaaugucaccguaugcgugaaauuauauauuucgggguagugugagcuuuuaauguuaagucauaauaaacucuuaagucaaauuaagcagacccggcauuggcguguagccauaacuuucugauguuaguaaaaacaaaauuggcgacuugaaacuaaaucaugccaagguuugauacacuugucuugagauauuaacgaaacacuuccaaacacugauacaaaguguccagauucucagauguuuguugugugaguuuuguuuaguuguauuuuuuuuucagugaaugucuggcacauugcaauccucaaacaugugguuaucuuuguuguauuggcauauucagugacuuguacauucagcaauagcauuugagcaaguuuuaucagcaagcaauauuuucaguuauguuuccaaauuaagaauggguuuaaacuugcugaauguaaagauugacccucaagucacuguagcuuuaguaguugcuuauuguauuaguuuagaugcuagcacugcaugugcugugcauauucugguuuuauuaaaauaaaaaguugaacugcacagucuccuuuguuguugucaauugugguuuacuuuuagaggugaaaauaaaguugugcucuugccucgugccaauauguacauaacugnacaaggugucaauncugcucuacagngnaguuuagncaguuuuagungnauagguucccaunguuuuuaungncuguuuaugcuaaaucuggccaaagaugagcauugcccaccacuaaaaugccuaugccacugggaauccuggguuanuuuggngaccagaaugaagugancaaaauguccanucuuuuuacaguggnauaggaagauggnaaaaauunccuaaagugnaauagauuuccaaguguuungugccugguncuaaaacuuuunuuaaguagggugcacunganaguauugaggncauugguuauggugcuauuuccanuuagucuagguuuaggcccu

SEQ ID NO: 172 - RNA, 3657 nt, Homo sapiens
cucggucuccaagaugguggcuaacaaaacgugaggccuagagguugauccuaggucacuggaagcauguccuugaagaggacuaugggcaucuggguucuuccucuucuacuuggccacgagguaaccggcuucuuguaccacgugugcucaccucuacaaucugugcggauucagacuccaagcaacuaggcuacccagugacaggcuaaaaacuacagcucuaacgucuuggaaggcgauuccauggaccaggauguggaaagcccaguggccauucaccagccaaaguugccuaagcaggccagggacgaccugccgagacacaucagccgagacaggaccaaaaggaaaauccagagguacgugaggaaggaugggaagugcaacguucaccacggcaaugugcgggagacguaccgauaccugacggacaucuucaccacccugguggaccugaaguggagauucaaccuguugaucuuugucauggucuacacagugacguggcuuuucuuugggaugaucugguggcugauugcguacauccggggagauauggaccacauagaggaccccucguggacuccuugugucaccaaccucaacggguuugucucugcuuuuuuauucuccauagagacagaaaccaccaucgguuauggcuaccgggucaucacggacaagugcccugaggggauuauucuccucuuaauccaguccguguugggguccauugucaacgccuucaugguaggauguauguuugugaaaauaucccaacccaagaagagggcagagacccuggucuuuuccacccacgcggugaucuccaugcgggaugggaaacugugcuugauguuccgggugggggacuugaggaauucucacauuguggaggcauccaucagagccaaguugaucaaguccaaacagacuucagagggggaguuuauuccccucaaccagacugauaucaacgugggguacuacacaggggacgaccggcucuuucuggugucaccauugauuauuagccaugaaauuaaccaacagagucccuucugggagaucuccaaagcgcagcugccuaaagaggaacuggagauuguggucauccuggagggaaugguggaagccacagggcaguucugaaaucgaaaucaagcagaggucuauaagaacacccuggagacccccaugcugcuggaucuuggguccaugaacugcuuuuauuugcugcaaucaaaaaugcuagucgcugaucugauaggagaggaaacgagacucagagccugaaggauaacacgcugagggcugauuucauacacucuucccggcuggaucaucccagcccccacagcguccaggcuuaguuucuuccuuuguuuuaacaaucuauacuuccuccagccugggcgagcuaguauacccagaguuugguuuuguuucuuuucagagcuguaagcccagugcccagugaccucaucugggaggagaguuaagcaauaagaccugaaaugcuaaacucugggguagaaaaccucugcagagacagcgucucugggaagucucuacagagacagaguagggaagucucacgaaggucagagucuuacuuccauaccuggagaaauccgcccguccguucagugccgguuucaacuccucugccaaagacuucuuuccaagacacugguaucagcuaucccagcaguaacuuuggcaguauauaaaucaauggcacugccccauaaaaccccguugaguaaaaccuauggucuucaacagcuggggagccuguagcccagcuccugugugaggcuaaggcuguggagaccaugccugcucaccuccucguugaaaagcaaaacacuguaagaaaccuaacaugacuuuuuccaacauuucucaggcuggggagaagacuugguccacaaagagcuugaggucuugaucuggaucccuagcauccauggaagaaggugggcaugaucacccacacuccucaucccauagcucugaaugagguaggcagauuccuggggcucaccagcucauccuaacagccaggucccaaugagggacugucuacaaaagaacaagagguggauccugagaagcgacacccaagcuugaccucuagccccuguacacaccuguuaagcaccugggcaucgggacacacacucgcaauuugcaaacaaggcaaauucucacacuucagaaggcacugagagaaucccauaagcucaaaaaguuaggagccaagauugaccauuaaugacuuggguugaaaagacuaaaccacuggauagaauguuucauuacuaaaacaccuuaccugaaaaguauuacugcucuucuuucugcaacuggaccaugcagagauccacaaagagaugcccagagauuauuagugauggucauaugauauacacaauguggacucuaagccaaggccccaucaacucagauccagaggcugacagugugcuuaucuuagagauaccacaguggcugccuaaucaccacguccuuaagucaggggaguuugauuauuuccuaugaacaccgaguggggacagcggauuaccaaugaagcaauccaaccugacaauccuaaccacccagaagaggaucgcugggggaaagcaugaauuauuuacgugucaacaugugcacacuccggccacgcagcucaacagccaggagugcuucuccacuuagcccugcccuggcauccauuuaugaucucgucuguuguguuaauuacccagcuagcuuuuuucucaaaaauaauaucucccagccauagaccuacucaucuguguccucuuuaauuucaacccacaguuacaucauucacuggcuugcucaguuucuucaacucugaaaugggaaugaugaugaugaugccucuucccccaagccaccauccucccccgugaccuuccuagguacagacucaaaccagggaagauuauuuccuucucauaggccacagggugaaaugcaauaaagaacaaagccuuguagggaggcagagggaaagaccaguccucacaagaggcuccauuguuuccagggacuuugaagcuuggacagaaugucagaugauccccuuugaaggugcuccaaagagucaaugugaaaaauauugacugaugugugcccguccacaagccaaggugccucugcccuggucaccuaccaugaauuauaaacugaugauauuugaaauaauaaggaacacuggagccggccagaaaggauucugcagucccauaaauagcaacauucaucacuacaaugccugccaacgguggccgugaauguagauuacccccggcucuucugaggccacugaggacagggcaaacuaccucugagaauggaggcucacuguucugcaucccacuucuaaauguuccaugaauuuuuugagacaucucccauaucccuguuagaaagauucaaccuugugcuauuaaccaaaucauuuugaauuccauaaaccucuacucuaaaguauacacuuaauucuacaauacagacaacaaauaugacuuuuuccuaugaaagagugauaaagauacuguaucagucugcuuugacucaaaaaaaaaaaaaaaaaaaaaaaaaaaaaaaaaaaaa

SEQ ID NO: 173 - RNA, 2267 nt, Homo sapiens
uggaaugggugcuaggugaaggcuuuguugaaucaggaugcugagcugguguuuuuacagguccagauaugaugagcuggaguuuugguaggcccagguaccuccuccaaaauugaccacauaauuggucacaaaucaggccuccacagauacaaaaauauugaaauuaucccaugcauccugucugaucaccacagacuaaggcugaucuucaauaacaacauaaaaauagaaagccagguucacugcugcggcugcgccuccuuguucucagcgucaccacugccgccaugcccggaggguugcuucucggggacgaagcccccaacuuugaggccaauaccaccaucggccgcauccgcuuccacgauuuccugggagauucauggggcauucucuuuucccacccacgggacuuuaccccagugugcaccacagaacuuggcagagcugcaaagcuggcgccagaguucgccaagaggaauguuaaguugauugcucuuucaauagacaguguugaggaucaucuugccuggagcaaggacaucaaugcuuacaauggugaaacacccacggaaaaguugccauuucccaucauugaugauaagggcagggaccuugccauccuuuugggcauguuggauccagucgagaaggacgauaacaacaugccugugacggcccgugugguguucauuuuuggcccugacaagaaacugaagcugucuauccucuacccugccaccacgagcaggaacuuugaugagauucucagagugguugacucucuccagcugacaggcacaaagccgguugccaccccaguugacuggaagaagggagagagcgugaugguaguccccacccucuccgaagaggaagccaaacaauguuucccuaaaggagucuucaccaaagagcucccgucuggcaaaaaauaccuccguuauacaccccagccuuaagucuuugcggaaauuggggcugcaucugcacguccagcacuggggccugaggacgucagccggcagccguggguccuugcagcagguccguagaaagaucguggcaugaucacagccgguccuguagaucgcucgcuauacuacugggucauuaaauggaaauggcaccaaaaccuucucgggauucuuuacucugugccuucgccagcauucugccccucugccugucacagugcccuacugacuggcucucuuugaaacgaauuauguauugaagauuccuuaggucucugcagggucuuugaucagcaagcaagguagugucagugugggcucugugcuagaaugaugaaacaccuuuuguagcuuuccgaacggaaucuucuguuacccauuuuggagagcacugacauggggagaagcuuucaauucuguauuuuuaguaaauaaaguggggacagccgggagaauucuuacagggaaucuauuguaaguuucuaucgaagugggcucagaaagccuuucgccucccaagagugcgcauguaccuccuagaguuuccacaucugcucucuggugaugucugccugugaacgcaccuuauaaaagacgggcggugacaguguuuuaccacucaguguccuaguaguggguggccauuucugaauucugcuuuuugagguucaacaaauaaaauccugaucagaaaaaaaaaaaaauagaaagccaacauucauguggaaacugaacaacacuacucaaugauuccuuggucagagaugaaauaaagaaagaaauuaaagacuuuuuagaguuuaaugaaaaugaagccacaacauacccaaacuuaugggacacaaugaaggcauuucuaagaggaaaacucauagcccugagugcauccaaaggaaaaaaaaaaaaaccuagagagaguguacacuagcagccugacugcacacuuagaagcucugcaaaaaaaggaaucaaauucacccaagaggaauagacagcaggaaauaaucaaacuuagggcugaaaucaaccaaauggaaacaaaaagaacuauucaaagagugggccaaaccaggagcuaguucuuugagaaaaucaacaagauagauaaacccuuagccagacucacuagagggcacagggacagcauccuaauuaacaaaaucagaacugaaaagggagacauaacaacagauccugaagaaauccaaaacaccaccagauccucuacaaaaggcuauacucaacaaaacuggaaaaccuggaugaaaggaaaagcuucuagacaga

SEQ ID NO: 174 - RNA, 2834 nt, Homo sapiens
augagcaccgcggaucugaugcgucgcugggucaucgcccugcuccuugcugcugccggaguugcaguagaagacucaggcagcaggaacgaguuccaguguagagacggaaaaugcaucgcuagcaagugggugugcgauggcagccccgagugcccggauggcuccgaugaguccccaaagacaugcaugucugucaccugucaguccaaucaauucagcuguggaggccgugucagccgaugcauuccugacuccuggagaugugauggacagguagacugugaaaaugacucagacgaacaaggcuguccccccaagacgugcucccaggaugacuuccgaugccaggauggcaagugcaucuccccgcaguuugugugugauggagaccgagauugccuagauggcucugaugaggcccacugcccagccaccacuuguggccccgcccacuuccgcugcaaaucauccauaugcauccccagucuuugggccugcgacggggaugucgacuguguugacggcucccaugaguggccacagaacugccaggccgaagacacggccuccaaaggcguuagcagccccugcuccucccuggaguuccacugugguagcagugaguguauccaucgcagcugggucugugacggcgaggcagacugcaaggacaagucagaugaggagcacugcgcgguggccaccugccgaccugaugaauuccagugugcagauggcuccugcauucacgguagccgccagugugaccgugaacaugacugcaaggacaugagcgacgagcucggcugcgucaaugugacacagugugauggccccaacaaguucaagugucacaguggggagugcaucagcuuggacaaggugugcgacuccgcccgcgacugccaggacuggucggaugagcccaucaaggagugcaagaccaacgaguguuuggacaacaaugguggcuguucccacaucugcaaggaccucaagauuggcucugagugccugugucccagcggcuuccgguugguggaccuccacaggugugaagauauugacgagugucaggagccagacaccugcagccagcucugugugaaccuggaaggcagcuacaagugugagugccaggccggcuuccacauggacccacacaccagggucugcaaggcugugggcuccauaggcuaucugcucuucaccaaccgccacgagguccggaagaugacccuggaccgcagcgaguacaccagucugcuccccaaccugaagaaugugguggcucucgacacggaggugaccaacaauagaaucuacugguccgaccugucccaaaaaaagaucuacagcgcccugauggaccaggccccuaacuuguccuacgacaccaucaucagugaggaccugcaugccccugacgggcuggcgguagacuggauccaccgcaacaucuacuggacagauucagucccaggcagcguaucuguggcugacaccaagggcguaaagaggaggacacuguuccaagaggcaggguccagacccagagccaucguaguggacccugugcauggcuucauguacuggacagauuggggaacacccgccaagaucaagaaaggggguuugaaugguguggacauccacucacuggugaccgaaaacauccaguggccaaauggcaucacacuagaucuuuccaguggccgucucuauuggguugauuccaaacuccacucuaucuccagcaucgaugucaaugggggcaaucggaaaaccauuuuggaggaugagaaccggcuggcccaccccuucuccuuggccaucuaugaggacaaaguguauuggacagaugucauaaacgaagccauuuucagugccaaucgacucacggguucagaugugaauuugguggcugaaaaccucuuguccccggaggacauuguccuguuccacaaggucacacagccuagaggggugaacuggugugagacaacagcccuccuccccaauggugguugccaguaccugugccugcccgccccacagaucgguccccacucgcccaaauucaccugcgccugcccugauggcaugcugcuggccaaggacaugcggagcugccucacagaagucgacacuguacugaccacccaggggacauccgccguccggccuguggucaccgcaucagcuaccaggccaccgaagcacagugaggaucucucagcucccaguacuccuaggcagccuguggacaccccagggcucagcacaguggcgucagugacagugucccaccaaguccagggugacauggcuggcagagggaaugaggagcagccacaugguaugagguuccuguccaucuucuucccuauugcacugguugcccuccuuguccuuggggccguccugcuguggaggaacuggcggcugaagaacaucacaaucaacagcauaaacuuugacaacccagucuaccagaagaccacagaggacgagcuccacauuugccgaagccaggauggcuauaccuaccccucaagacagauggucagccuggaggacgauguggcaugagcagccgggagagccgucucuuuccgggauccauugccaagcuuaggcagaaaagacacucucuccagaccuccccauccagcacugguccugccaccucccugggucuguguugcucaaagcaagauagagcaaagcugggcuggggggccaagcucagcuuccugucugccccagguucuguuuuauauauuuauugucugggacagaaaaggcuacuggcugugcuugaaauucga

SEQ ID NO: 175 - RNA, 2940 nt, Homo sapiens
accggucaucgggcucuuccuugggcucagggcacggaucaaguccucggcucgcucggccagcaccgcggcaccauggcgcaggagcugcagcaccccgaguucgcgcgcgcaggccagcaggcugggcugcagguguggagggucgagaagcuggaacugguaccggugccccagggugccuauggugacuuuuacgucggagagcccuaccuggugcugcacaccaccaaguccagcaggggcuucuccuaccgccugcauuucuggcugggaaaggaguguucccaggaugagagcacagcggcugccaucuuuacgguccagauggacgacuauuuggguggcaagccaguccagagcagagagcuucaaggcuaugagucgacugauuuugugggcuauuucaaaggcggucugaaguacaaggcuggagguguggcuucuggacuaaaccauguccucaccaaugaucugacugcgaaaagacuucugcacgugaagggucggagaguggucagagccacugaaguuccccucagcugggagagcuucaacaagggcgacugcuucaucauugaccuuggcaccgaaauuuaccaguggugugguuccuccugcaacaaauaugagcgucugaaagcaagccagguggccauuggcauccgggacaaugagaggaaaggaagaucucaacucauugugguggaagaaggaagugaaccaucagagcucaugaagguuuuagggagaaagccugagcuuccagauggggacaaugaugacgaugucguagcagacauaaguaacaggaagauggcgaagcucuacaugguuucagaugcaaguggguccaugaaaguaacacugguggcugaagaaaacccguucuccaugggaauguugcuuucugaagaaugcuucauuuuggaccauggugcugcaaaacaaauuuuuguauggaaagguaaaaaugcuaacccacaggagaggaagacugccaugaagacagcugaggaguuuuuacagaaaaugaaguauucuacuaauacucaaauucagguucuuccggaaggcggugaaacaccaauuuucaaacaguucuuuaaggacuggaaggauaaagaccagagugauggcuuugggaagguguacaucacggagaaaguggcucagauaaagcagauuccguuugaugccucaaaacugcacaguucuccgcagauggcagcccagcacaacaugguggacgauggcucuggcgggguggagaucuggcguguagagaacagugguagaguccagauugacccaagcuccuauggcgaguucuauggcggugacugcuacauuauccucuacacuuaucccagaggacagaucaucuacacauggcaaggagcaaaugcuaccagagaugaacugaccauguccgcguuucugacuguccaguuggaccggucccuuggagggcaggcugugcagguccgugucucucaaggcaaagagccugcucaccugcugaguuuguucaaagacaaaccacucauuauuuauaagaaugggacauccaagaaagaagggcaggcaccggcucccccuacacgccuuuuucaaguccggaggaaccuggcaucuaucaccagaauuguggagguugacguugaugcaaauucauuaaauucuaaugacacuuuuguccuaaaacugccacgaaacaauggcuucaucuggauaggaaaaggugcuagccaggaggaggagaaaggagcagaguauguggcugauguccucaagugcaaagcuucaagaauucaagaaggcaaggaaccagaggaauucuggaacucucuuggagggaggggagacuaccagacuucaccauugcuagaaacucgggcugaagaccauccaccucggcuuuaugguugcuccaacaaaacuggaagauucauuauugaagaaguuccgggagaguucacccaggaugaccuggcagaagaugaugucaugcuacuugaugcgugggaacagaucuuuauuuggauuggcaaagaugccaaugaaguugagaaaaaggaaucagugaagucugccaaaauguaccuggagacagacccuucuggaagagacaagaggacaccgauugucaucaucaagcaagggcacgagccccccacauucacaggcugguuucugggcugggacuccagcaggugguaaaaccagcaacuauccuggcugcauuggggcagcugccacuuuguuguuggggaauuguuuacuuuuuguuauuggcuuuugaagauaaacuccugccaaauggauauauaucuauaucuauaucuauaucuauaucuauaucuauaucuauaucuauaucuauaucuaucuauaucuaaucuauaucuaucuaucuaucuaucuaucuaucuaucuaucuaucuaucuaucuauaugcuccucuuuuccuucucuuucaaagggaauugcuguauguuacuauacugaaauaaccuaaagcaaccauuuguuuucgagcaauuuugcaaucuggggaccucugaggaaguaauuuugucauucagccacugcuagccaaacuugucuuuucccauagagaggaaggagagccacagugcuucuaagcauuuccccgucugcuacucuguuugcagugagcuuuacuuuauguauggcuuuaacaaugccuugcuguuucccaucucaagucaaugccacuuggaugccauucacucccaaguguccuuacauaggaugaacuucuuuagcuuuuuuagaaaacuaaaaucaugucuuuuaugauaaaacacauuuuauuucuauaaguuuaacuuuauauauuugauagcacaugcucaauagcauaaagaauaugcauugaaugauguuuuucauaauuaaaauauauccuuuugg

SEQ ID NO: 176 - RNA, 1714 nt, Homo sapiens
caggguugagagcaagaaggugcaggauguaggccagcagaauuaucagacccaguggcggcuucugccacuggaagaauuuccaacauaaaacagaugaucaguuugggacaaucgauucugcgaccagagguagugucaucugguuacuuuuaaaauucagauugucugguguuuuccaaucacucgcgacuguaauuugaaguuggauucugagauaauacaaucgcugucgcucuaguuuauaaagcuguccaagaucugcccagucccagauguccuggguccucagggcggcuguggucugcgcccuucuccugcagcuggaugccagaccauccuggacucggaucccuuuggguucacacucgcuuagguauuucuacaccgcugugucccggccuggccuuggggagcccugguucauaaucgucggcuauguggacgacaugcagguccugcgcuucagcagcaaggaggagacuccgaggauggcacccuggcuggagcaggaggaagcagaugacugggaacagcagacucauauagucacaauucaaggacagcugucugaaaggaaucugaugacccugguucauuuuuacaacaagagcauggacgacucucacacacuacaguggcugcaggacugcgauguggagccagaucggcaccugugucucugguacaaccagcucgccuaugauagcgaggaucuccccacccugagcgaaaacccaaguuccuguacagugggaaacagcacuguaccucagaucucucagcaccuggagggccacugcucagaugugcugcagaaauaccuggaaaaagggaaggagaggcugcugcguucagaccccccaaaggcacaugugacccgucaccccagaccugaaggugaugucacccugaggugcugggcccuggguuucuacccugcugacaucacccugaccuggcagaaggauggggaggagcugacccaagauguggaguuuguggagaccaggccugcaggggauggaaccuuccagaagugggcagcugugguggugccucuuggaaaggugcagaguuacacgugccauguggaccaugaggggcugccugagccccucacccugagaugggagccugcaugguaccaaaagccuuggauuuggauuguugccacgguuuuuuccauuuugcucauuugucucuguguggcucgcagacccaugaagaagaaugcaggugggagaggaaggcgugacacccaagaagcaggcagagacaguccccaagacucuagcaagacuguuguggaugaugaggagauggggguuugcuuuuggaagauuaaguccuguaaaacuugucuaggccacuccccaggaacuucaggaucaucugggagaugccccuuugaguggcugggcugugaggacagcaggccaguucuugccacccuggacagaaacacaucucaccuuucuggcucgaggaucugaacaccugucucuugccuacucggcuucuagucaggcauuuugucaccuugucaagggucccagggacacaaagcucccuccucucacccacagcacucuggguccuacccccaaugcuucagggacauuuaaucaggucaaauugggaucaauggcuuugaugcagaaaagaacuguggacuaauagagauaggguuuaauaaaaaaaauaucuuuuu

SEQ ID NO: 177 - RNA, 467 nt, Homo sapiens
uuuuuuuuuuuuuuuuucaacuuuaaagacuggauuugagguucagucugggucucugggggggaccucugucaucacgccuauaaucaucccgagaguagucaucccuggagcuccacgaccgaucaucccgucugucauagcggucuucauagcgguccccaccuccucuguagucaucaucucuccgguacccacuuccaaaugcccuucugccacugccuauccuggagucauagccucggucauagucucugcugccucggucaucauagcgaucccggcccccauagcgguccaugucucugcgugggccgucccgauauccgucccuauacccaucccgauaccggucugaaucguaacgaucucgauacuugucuccaaagcuaucaucgccucuucuagguggguagucaucacaacugucuguggugggacgggcccuccagucugugucuguuuug

SEQ ID NO: 178 - RNA, 346 nt, Homo sapiens
uuuuuuuuuuuuuuuuuggcccccaggcucugucucaaggaugggaauagaucaagccaaacagugaaaaauaaggcaaaucguggcuucgggguuugagacuggcaccaauggcaaaucagcagaggagaugcaaaugggguaacaaucacaguuagugggguaacaugagcaggcaggaaacccuugagacaacacccaagguccacgucuucgcaugugcagggcacaacuccagcagcaguuucugggcuuggaggcuuguuacucuuccuaccuuucccacccccuaaaagacaccaagauggagcccacgaagagauuacaucaagcucuucuggcuggg

SEQ ID NO: 179 - RNA, 4902 nt, Homo sapiens
ucuaggacagccagggcuacacagagaaacccugucucaacuaaaacaaagcaaaccccccgaauauuguuuuuuauuugcggaugucuguuuauugagacgggguucauggcagacaugagugucucagugcauuugcuauccucucuucuaaaggggcgggggggggggugcgcuggagagguggcucagcaguuaagagcacugacuucucuuccagagguccugaguucaauucccagcaaccacaugguggcuuauaaccaucuauagugagaucugaugccuucuucuugccuguaggcagaccacuguauacauaauaaauaaaucuuaaaaggggggggaagguguggagcuaaaaguauggcaauaugcauaaguuuagcuauuucuguuguuuugcagucaucagugagccaaacuaauucgaauggguagcuagaucuuguugcuuuuagcgaauauauauugagugaauggaauugacagucuucuguauucucauucaguuuguuuguguucuuccccaucagugauaacauguagugaacuaacccguguggaccaucuuaaccauggcuucuccuuccuuuucuguuuuaaacauaggacauggauuugauugacauccuuuggaggcaagacauagaucuuggaguaagucgagaaguguuugacuuuagucagcgacagaaggacuaugagcuggaaaaacagaaaaaacucgaaaaggaaagacaagagcaacuccagaaggaacaggagaaggccuuuuucgcucaguuucaacuggaugaagaaacaggagaauuccucccaauucagccggcccagcauauccagacagacaccaguggauccgccagcuacucccagguacacucgucguggugggagcuaaggaaaacucuagugagaaagcagacucucuggaguugaguucuuggucugccauuuacugugucuuuugugaggaggagaaguucucaaacuucgcuucuugauaaucaggacacagaucacagggaggacuuugugaguucagaaacauccucuguggugaugaaacagcggcagaaauacuguugggaguaaaagaaguaggcauugcucauugugguaggcagggcccugauuguauggguaacugacuuaacuguguuaaguaugauucccauuuuauauucccaugucuaaacaacuaaagcauuugcccagaacacucagaaagaaaugaagggagguuauugccuagcacagagcccugguucagucccccacgcuguucguuaaaggggagggacuaauaauuugaacacaaucugguuugaaucuaugcaaaucgauuucugaaaugagaccauagguuauuuuaugaacaagucuuauugcucguugugacccugugcuuagaacauuucauaaaugaugcucucugugccuuuccccuuccuccagguugcccacauucccaaacaagaugccuuguacuuugaagacuguaugcagcuuuuggcagagacauucccauuuguagaugaccaugagguauaaaaauguuuguuuaacagcaaaacucccuuaucugauauuaguuccuuucaugugucuccaauuaagagaagaaaagaaaauuuuagaaggaaaaaauugaucaaagaaauugucaaguaaacuguaugagagcuauauaaugcuuaaaaauaagaccuguaugggcuggugagauggcucaguugguaagaguacccgacugcucuuccgaagguccagaguucaaaucccagcaaccacaagguggcucacaacauccauaacaagaucugacucccucuucuggagugucugaagacagcuacaguguacuuacauauaauaaauaaauaaaucuuuaaaaaaaaaaaauaaggccuguaaacuacaaguccauuuuacuguauagcuggaaacaggaaucagaauaauuuucccuggaaacuggauauagauauauaaaauauuuugacuaguaaagaacaacuauuaaucagcauuuggauuaaaaaaucuuaaucuguuguuugaagcauucugcuagauauuauggguacagauuaaguccuaaugaauguuuuuauccauuuugaagucugccuuuaaauacauggagugaaauaaccuaggaguguauuaauauggagucacugggaggaggaaauguuucauuuuauaaaagcagccugagagcuguaggcccugcugcugucuguucuucaugccuuggcucucacucacaugaaucaaugucacgucaaucuuggcuuucuucacuugcauuucagucgcuugcccuggauauccccagccacgcugaaaguucagucuucacugccccucaucaggcccagucccucaauagcucucuggaggcagccaugacugauuuaagcagcauagagcaggacauggagcaaguuuggcaggagcuauuuuccauucccgaauuacagguaagagagcucuaggagugugcuguuuucugcgggcccuuuuaaauuagucauccuaguuauuuauuauuuacaugcuaccuccucaaaggaagaaauugaugguguauuuaaauuacucaugagagcuucccagacucacuuaacacacauaguuuuuagguaaucagacugaauauuucuggauaaauucauucaaagacugaaagcuaauuuagaguucugacaaagauaaaauacuuaucuauugaaaaaugggaguugaaggaauuauugaaaagaacaccuuggauuuggggguagggaauugaucuaaaaugcacuuagccucugcucauacaaugugaccuucuuuccuagugucuuaauaccgaaaacaagcagcuggcugauacuaccgcuguucccagcccagaagccacacugacagaaauggacagcaauuaccauuuuuacucaucgaucuccucgcuggaaaaagaagugggcaacugugguccacauuuccuucaugguuuugaggauucuuucagcagcauccucuccacugaugaugccagccagcugaccuccuuagacucaaaucccaccuuaaacacagauuuuggcgaugaauuuuauucugcuuucauagcagagcccagugacgguggcagcaugccuuccuccgcugccaucagucagucacucucugaacuccuggacgggacuauugaaggcugugaccugucacuguguaaagcuuucaacccgaagcacgcugaaggcacaauggaauucaaugacucugacucuggcauuucacugaacacaagucccagccgagcguccccagagcacuccguggagucuuccauuuacggagacccaccgccuggguucagugacucggaaauggaggagcuagauagugccccuggaagugucaaacagaacggcccuaaagcacagccagcacauucuccuggagacacaguacagccucugucaccagcucaagggcacagugcuccuaugcgugaaucccaaugugaaaauacaacaaaaaaagaaguucccgugaguccuggucaucaaaaagccccauucacaaaagacaaacauucaagccgcuuagaggcucaucucacacgagaugagcuuagggcaaaagcucuccauauuccauucccugucgaaaaaaucauuaaccucccuguugaugacuucaaugaaaugauguccaaggagcaauucaaugaagcucagcucgcauugauccgagauauacgcaggagagguaagaauaaagucgccgcccagaacuguaggaaaaggaagcuggagaacauugucgagcuggagcaagacuugggccacuuaaaagacgagagagaaaaacuacucagagaaaagggagaaaacgacagaaaccuccaucuacugaaaaggcggcucagcaccuuguaucuugaagucuucagcauguuacgugaugaggauggaaagccuuacucucccagugaauacucucugcagcaaaccagagauggcaauguguuccuuguucccaaaagcaagaagccagauacaaagaaaaacuagguucgggaggauggagccuuuucugagcuaguguuuguuuuguacugcuaaaacuuccuacugugaugugaaaugcagaaacacuuuauaaguaacuaugcagaauuauagccaaagcuaguauagcaauaauaugaaacuuuacaaagcauuaaagucucaauguugaaucaguuucauuuuaacucucaaguuaauuucuuaggcaccauuugggagaguuucuguuuaaguguaaauacuacagaacuuauuuauacuauucucacuuguuacagucauagacuuauaugacaucuggcuaaaagcaaacuauugaaaacuaaccagaccacuauacuuuuuuauauacuguaugaacaggaaaugacauuuuuauauuaaauuguuuagcucauaaaaauuaaaaggagcuagcacuaauaaaagaauaucaugacuuaaacuacuuuggacuuuuugaauuuauucacacuauuuuccauaggacaaucacucauuuaccacauuugguuauuuuacauuuucaaaauggguuugaaaauacagaggcauuuuauagccauguguggcaguccaugauuuuuuauucccgacauucaggaggcagaagcaggcagaucccugggcuccaggacggccaaggcuacaugagagccugucucaagaaagacaaacccuuucuauacuaaacguuagcuaggauugucaaggagaugguauauauccacaaugguaugccugcuguacaguacuguggcacagagaacaaaaccuguaaccuccuguguucuuagaaguggcauucuaagaagggcuaggaaga

SEQ ID NO: 180 - RNA, 462 nt, Homo sapiens
ggccagcaggacucuccuugcagcagcggcccgaguucagaguccggagcugcggugguggcggcgaaggcgagagucauggcuggacaagcuuuuaggaaguuucuuccgcucuuugacagaguauugguugaaaggagugccgccgaaacuguaaccaaagguggcauuaugcuuccagaaaagucucaaggaaaaguguugcaagcaacggucguggcuguggggucaggagggaaaggaaagaguggagagauugaaccugucagugugaaaguuggagauaaaguucuucucccagaauauggaggcaccaaaguaguucuagaugacaaggauuauuucuuauuuagagauagugacauucuuggaaaguaugucgacugaaaucacuguugaaauggugucacgugaagcugccauuccacugaugucugaacuauuucaucauguaaauaauuu

SEQ ID NO: 181 - RNA, 417 nt, Homo sapiens
uuuuuuuuuuuuuuuuucaggucucauuuucguuuauuugaaauucggugcucguguaaguuuuuucucuuccccucaaauuuuauuucaguaaaaggagacuugggcgagguggauaccccacagccggauucuucccccccugccccccaggguggcuaaugcuaucuggggaagucgucauagggaagagaacuaugggugggcuccugccugaggccuccaaucucagcccaguggacauaucacaggcagcuuaaaaaaaaaacccuaaaaaaaacaccccaaaacacacauuuaaauagguauucaagacagcuuuaaaaaaugcacccacucacaccccccucccuuuucuuuuuggaaaaaaaaauaggaaaaaaaaaaaaaccaaaccgaauucucgcuuggccucua

SEQ ID NO: 182 - RNA, 1160 nt, Homo sapiens
auuuggcuccgaggccaagaauucggauccaaggcgggcgcggggaaaauggcggcggcagcugcggcgggggcgaaugggagcggaggcagcagcggcauggaaguggaugcagcaguccccagcgugauggccuccggagugacugggaguguuuccgucgcucuucauccccuugucauccuuaacaucucagaccauuggauccgcaugcgcucccaggaggggcggccuaugcaggugauuggggcucugaucgggaagcaggaggggcgaaauaucgaagugaugaacuccuuugagcugcugucccacaccguggaagagaagauuaucauugacaaagaauauuauuacaccaaggaggagcaguuuaaacagguuuucaaggagcuggaguuucuggguugguauaccacaggggggccaccugaccccucagacauccacguccauaagcaggugugugagauaauugagaguccgcucuuucugaaguugaacccuaugaccaagcacacagaucuuccugucagcguuuuugagucugucaucgauauaaucaauggagaggccacaaugcuguuugcugagcucacuuacacucuggccacugaggaagcugaacggaucgguguagaccacguggcccggaugacagcaacaggcaguggggagaacuccacuguggcugaacaccugauagcucagcauagugccaucaagaugcugcacagccgugugaagcucauuuuagaauaugucaaggccucugaagcaggagagguucccuucaaccaugagauccugcgggaggccuaugcccuaugucacugucucccaguucucagcacugacaaguucaagacagacuuuuaugaucaaugcaaugacguggggcucauggccuaccucggcaccaucaccaaaacgugcaacacaaugaaccaguuugugaacaaguucaacguccucuacgaccgacaaggcauuggccggcgaaugcggggacuguuuuucugaugaugguucuggaagggaugguguguggggcucagacagcuguuccauggaccugaguaccacauucccuuuagagaaacucauuaauaaaagagcagccccuuaaaaaaaaaaaaaaaaaaaaaaaaaaaaaaaaa

SEQ ID NO: 183 - RNA, 8322 nt, Homo sapiens
  misc_feature (1298)..(1397): n is a, c, g, or u
  misc_feature (2040)..(2139): n is a, c, g, or u
  misc_feature (2495)..(2594): n is a, c, g, or u
  misc_feature (3800)..(3899): n is a, c, g, or u
  misc_feature (4897)..(4897): n is a, c, g, or u
  misc_feature (4909)..(4909): n is a, c, g, or u
aaaacccaauguuugguuuuaaagccaaaaauauaagggaagugcauagguuuggguuuuguuuuuuguuuuuucccgagguccuugaucuuugcccccaaauuugagggcauaaaguaaucccucaguuaccuaaaaacacagccauuccuuugccauuccacucuccuggauuggccgcuucugugcgcgggggagaggugacucacuauuacuacugaggaaaggggagccagugguggaaguggggugagucacugaugggcagcagcuucagcccuccccccaacuuccuuggcucucuggggaugccugauccucucccucacuuugcaccuacuuccccuggucccucaccacuacccuuugcccacccacucaaauucuuuggcucugcucuuuacuccagaaggccaaaggcaagcuuagaguugaguaggcaggaaccaacauugugaagccccaggccagaaagggguguucugcagagugaggguuggcaugcuggcuccuccucaccauaccugcccccgccccuuuggguacaggauggcuccuuuaagagcaguggauccacccccuguagaggagggccuauuagagccucugccuggcugucagugacucaguguucgcgggaacgcugccucagccucaacaccagccaacccagaucccgaggugcgccagcgcccagcccagaucuccacgccugccaggagcgagcuucgccggcucgcugucccccugagcagccucuguccuucuguccaagucccgcgcccuucucgggaccccugcccagcgggcagcacugucacccugccggccauggagaccccgucacagcggcgcgccacccgcaguggggcgcaggccagcucuaccccacugucgcccacucggaucacccggcugcaggagaaggaggaccugcaggagcucaaugaccgccuggccguguacaucgaucgcgugcguucccuggagaccgagaacgcggggcugcgccuucgcaucacugagucugaagagguggucagccgagagguguccggcaucaaggcggccuacgaggccgagcugggggaugcccgcaagacccuugauucuguggccaaggagcgcgcccgccuccagcuagagcugagcaaagugcgugaggaguucaaggagcugaaggcucggugagugaggcccggccggccggcaccagggaggcagcagucgccuguaacuggccaucuaguccccucccuccccggaacugccucccgcgggugacuggcagugccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcuaggccagauauagaaagcuuucuguauuuaauacacaguacaugcaucauucaugucuacauaauuaagauaaaggaagcugcauuguuaaugggaaaaaaaauagggucugggaauguagugugccuagcauuuacgaacuucgggguuuggguuugaucccagcaucucacaaaccacguguaaucccagcacuuggaagguagaggccggaggauccgaaguuuaaggucauucuugacuacuuagcaaauucggggcacccuaggauaccugagacccugucaugaauaaaaauaaauaauaaauaaaccaauaugggucuagguugagcagcagcuugggcaggguagggccggaaguuagccagguagaggguugcagucccaggaggacccuggcugggagcagcaccucaguccccugcccaaccacagggggccaccgggucuuuccggaacuccugagggcgcaaggccuugcucucucuggcccagccauggggaacgcggagggccggugaggcaggcggcaggcgggcgggcggggcgcgggccgucauccccuccugcuccuuauuuuuagcccaguguagagucugggccgccugucccucccccaggacagggggaggaaauunnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaugccaacaauccuaauguaaugaugcccucuucugacagcugcggggaccgcagagaggucccaucccagaugcacuccugaaaccugcuuuucuuuuucuagcaacaccaagaaggagggggacuuguuggcugcgcaggcccggcucaaggaccucgaggcucuucucaacuccaaggaagcugcccugagcacugcucucagugagaagcgcacauuggagggcgagcuccaugaccugcgggggcagguagccaagguaggccgcuguccugugaccccagugaccccaccugguccgacauaucauucggucccauuugccugcucaccuucacuucuccagucuagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnucuagauggggacagccaucaccucuccuuuggcauuuccugaacccccucccaccucuccaugaacuuggcuuucucccucucagcuugaggcggcccugggagaggcuaagaagcagcuucaggaugagaugcugaggcgaguggaugcugagaacaggcuacagacgcugaaggaggagcuugacuuccagaagaacauuuacagcgagguaagcgucccgcuguacaggucuuucuuacuguggacagcugggaggggucaccuaauaaugccaggcuaagcgagggcugcccgugccuggccgguggaguuacgacuucuggucucagcuucuaaggaaccauugcgauguucuaaucuaagugucuccccuuaaccuuucaggaacugcgugagaccaagcgccggcaugagacgcggcuuguggagaucgauaacgggaagcagcgagaguuugagagccggcuggcagaugcccugcaggagcugcgggcucagcaugaggaccagguggaacaguauaagaaggagcuagaaaagacauacuccgccaaggugcuggccucauccuguccucucccuggugcugcccuggggacgggugggugguggcagggggccagggaugccuuccucaggcccccagcuccagguuccugcucucauaacugugugcucccugcagcuggauaaugccaggcagucugcugagaggaacagcaaccucgugggggcugcccaugaggaacugcagcagucucgaauccgcauugacagccucucggcccagcucagccagcuccaaaagcaggugacccucaguuuaccccucccaccuuggcucuggucuaagcagauacugcagaagcccacugagaagggggugggggagggacuccaggaccacaugcuaugguucugaaucugaugccugucuggcuuuccagggcucuccuuuagcuagcccugauccucagagccucuauuuuacugugcaugaaggguuuuucauguuucuucugugccugccggagacugaaccagaggccucuugcuugguagauaggugcuuucucacugaguuacaaacccagccgcauucccuacuuggagauagagcuucccuuggacuggacauguagcucaguugguacagugcuugcuuauuauacacgauggccuggcuucuauccccaggaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnucuagagagagccuacagauccugagugucccucugccugccccugugccccucccucuucaucgacaucagcccuugggagcucaucagacccuuugucuuccccgccccaguuggcagccaaggaggcaaagcugcgugaccuggaggacucgcuggcccgugagcgcgauaccagccggcgccugcuggcugagaaagagcgagagauggcggagaugcgggcgaggaugcagcagcagcuggacgaguaccaggagcugcuggacaucaagcuggcccuggacauggagauccaugccuaucgaaagcugcuggagggcgaggaggagaggugaacuaggaggggucuacagaacuugucaggggccucuggccgcaacuaccaugacuaaccccgcaccgugucuccaccuuccccaggcugcgccugucccccagcccuaccucgcagcgcagccguggccgcgccuccucccacucaucccagucucaggguggaggcagcgucaccaaaaagcgcaagcuggagucuuccgagagccggagcagcuucucgcagcaugcucgcacuagcgggcguguggcgguagaggaagucgaugaagagggaaaguucgugcggcugcgcaacaaguccaacgaggugggccugugaaccaggguggucuuuucaguggcugggaguucuugguucucguggagcaucugucucccuaucugagaauuuggagugugugguaguccugucaucuuuaaauuguugggaagaugcaugauauagggaugggugacccuugagccaauagucuagguuugaugccagagguagugguggaagccugucuuucuuuucuuuuucuuuuucuuuuucuuuuucuuuuucucuuucuucucucuuuuuuuuuuuuccgauggggucuugcccagguuggcuuugaucucccuaguuaagcuguuccccugccucagccuccauaguagcuggaacugcaggngcacacuggcgnccagccuaccuaagcuccugagugagauaauccaagagucgguugaacucccuguccuccuuccuccuuccuccuuccuccacccuacuucaggaccaguccaugggcaacuggcagaucaggcgucagaauggugacgauccuuugaugaccuaucgcuucccaccgaaguucacccuaaaggcugggcagguggugacggugaguggaagggcacuugggacucuggcuggaguggagaaguuggccucaggacaggagcauuaaaaauaagcacaucucuuaaaccaucuuuucccagaucugggcuucaggagcuggggccacccauagccccccuacugacuugguguggaaggcgcagaacaccuggggcugugggagcagccuucgcaccgcucucaucaacuccacuggagaagugaguauguugcagccgguagcuugcuggacaaggcucccccgggugaccauaaugggaacuagcuaccuccaacccaagggaaccugccuuggguuuaggaucgcuuuccugagcccaagucccacccaguaagcaagccagaagucuccccaguagaauaauggguggaagucagccagugaguguuaauagcagacuccagcuuacagagcaccgagcucucaguuguguccuuuuugcgcgugcgugcgcgcgugugcacaugugcauguguuuauccuuaguccccagcaucagagguuggacaagguuguauaaaggcccgggacaguucuaagugguuacuauggguagacaggcugcacagcccucacccccugacucuugggccugggcuuauguccccacaggaaguggccaugcgcaagcuggugcgcucacugaccaugguugaggacaaugaggaugacgacgaggauggagaagagcuccuccaucaccaccgugugaguggcagccgccgcugaggcccagcccacaaggguagcccugccagccuagggcagcucucccaccuccaugccaaagucuuuucauuaaagaauguuuuggaaugccacuugcugcccuggccuuucuucucucuccucccucuaccuugaacagggaacccaggugucugguaaggaagggaguggggacuugcugaugccauggauacuccacgguggcaguggacaggguucuggauuuguguccugggaaggggcugggaggacagagguggccccagcccugccucucuuccucacucccauugcaugcacacuucucuccucucuccuuccacccuauugcaugcuucuccucagauuucccugcaacaauguucucuuuccuuccuguccccucacaaauuaagucucuccaucuuugcucuuccucuugauugccccauaagugucuaagauucaggagagaguuaaagccacagcucuuuauuucgaaggcuuccuggcuauuucccccaucaugcccuuccucccagccacaggucucccaaguccccaucacuugguugucuggguacagacagaggucaccuuccugcccaauggccaggaagcuccaagagcccacagccuaggugccgguccuaagaagucagucccaaacucgcugucccuccugagccuugucucccuucccaggguucccacugcagcggcucgggggaccccgcugaguacaaccugcgcucacgcaccgugcugugcgggacgugugggcagccugcugacaaggcugccgguggagcgggagcccaggugggcggauccaucuccucuggcucuucugccuccagugucacagucacucgaagcuuccgcaguguggggggcaguggggguggcagcuucggggacaaccuagucacccgcuccuaccuccugggcaacuccaguccccggagccaggugagucaucucugcccuacagcaggacacugcucacugagcagcagggcagggcagcccaagggaguggggucccccuccuugcagucccucuugcauccugccccuccugucugaaccccagacucgaggucagggcaaggcccagagugugaggguuggggagacaaccccuuuggggucagggagggagaggaagggccagccacugcugcucacaccucugccuucucuucucucuuagagcucccagaacugcagcaucauguaaucugggaccugccaggcagggcugggggcagaggccaccugcuccccccucaccacaugccaccuccugucugcuccuuaggagagcaggccugaagccaaagaaaaauuuauccccugccuuugguuuuuuuuuuucuucuauuuuuuuuucuuuuucuaagagaaguuauuuucuacagugguuuuauacugaaggaaaaacucaagcaaaaaaaaaaaucuuuaucucaauccuaaguccuuccccuuucuuuccuuguaucugccuuaaaaccaaagggcuucucuaggagcccagggaaaggacugcuuuuuauagagucuagauuuuuguccugcugccuuggcuuuacccucaucccaggacccugugacaauggugccugagaggcaggcauggaguucucuucaccagccuccuccaacagcuggcccacugccacgccagcugcagagaaauggggcgcagagaggaugacugagaaggucaagccccuccccggcacuacacgaggccgaggcuccucugccugccuuaccuucuuccugcccuucccuagccuggggcgaguggauucccagaggcaaaucugccgugcuugcuuuuucuauauuuuauuuagacaagagaugggaaugacggggaaggagaagggaagaucaguuugagccuaccuuuucccagcuucugagccuggugggcucugucucaaugauggagggcaaugucaagugggauacagggaagagugggggacgaaggcucccagagauggggagaaccugcuggggcuggugagaagucuagaggugcggcgauugguggcuacagcaaacacuaaggaacccuucaccccauuucccaucugcaccucugcucuccccuccaaaucaauacacuaguuguuuccaucccagaugcuguggugucucuuuguugggugugauguguguuuucaggggcagacacaugcacacagaggugccacacauucacuauauauucacuacccagcuauaaagguguguaugagggagacuucuagaaaggucagcauauguggggugagcgagggguguccuuccuaucccucauccauccagcaccuuuuaaaaggggccagcaauccacaugugcaucagacacaggagcacagagagacggaggguagaguagggcagaguagcagagcuuccuugcugcccuguagucgcaggcucuugaucgugugaucgcu

SEQ ID NO: 184 - RNA, 1054 nt, Homo sapiens
gcggugcgaagcgggccuccgccaacauguacuacaaguuuagcaguuucacgcagaaguuggcuggagcuugggcuucggaagccuacaccccgcagggguuaaagccaguuuccacagaagcaccaccuaucauauuugccacaccaaccaaacugaccuccagugugacagcauaugauuauucugggaagaacaaaguuccagagcugcagaaguuuuuccagaaggcugaugguuuccaccugaaacgaggccuuccagaccaaaugcuuuaccggaccaccauggcucugacacugggagggaccaucuacugccugaucgcccucuacauggccucgcagcccagaaacaaaugagcuugccuguggaggacugguucacuuuguggcacaaacccuuugaauccucacguuucauguuuuccacuuggauagucuacuuaacauuuugcaaacaaaggaaaagauaagaauacauuguuuugauuuguuuauggugugcagauggccugucagaugucagagcugguuugacaguuaaaacuauuguuuaaggaaaugucacugagccaucacugagcugugcuucugcuccugauuucccuggaguucugcaggaaaguugcucuccagcucauucguggccagccgugcucagggccucgggacucaggcggugucugagcgggaagcgaacgcggaagccuuuuggaguguaggugugauugaggaaggaaaacaaaagccagcggacagguggugaagugagggcugaguuagccacccuagggauucguccgccuugcagaaaacauugagaggaaugauagcaaccugccucuauuugugggcaguugguuucaaaggguugugugucucgcccagaaccuagggaaauggguguuuguuccaucgugggaggagcaccugucagugcugcacauuagacagcugugucaggacuucuccuuuaauaaugcuguggcuuuacguuaugauugaccggacugcggaauaaacacuggaaucaaaaaaaaaaaaaaaaaaaa

SEQ ID NO: 185 - RNA, 4208 nt, Homo sapiens
cugagacagaacgaaacguccgcagauaacuacccguucuggcucuuguuaguucuauguguauggauaaugucuugggagguuuugaaaugccacaagccuugcuggcccagggugcagcugccucugccguucagaccucagauuauaaggacagaacacagcacggaaguggggggaucagaaccaugggagauccaggacgaaggguccugugcgcaggugcggcaccgaauccuauauuugacauugaagcugucgucagcccaacuaguguguuauuaacauggaagcacaaugacucaggcgcuucagaauguagaauagagaauaagauggagagcaaucugacguuuccuguuaaaaaccagacaucauguaacauuacaggcuuaagcccagguacuucguauacauucuccaucaucucuguaacaaccaaugagaccuugaacaaaacuaucacaacagagcccuggccagugucugaucuccaugucaccucugugggugugacacaggcucgucucaccuggagcaaugcaaauggcacugccuccuaccggaugcugauugaagaguugaccacacauuccucagucaauauuucaggucugaagccggggaccaauaauacguucgcuuucccagaaucaaaugagacacaggcugacuuugcaguugcagaggaggucccggaugccaaugguaccaagagaaucccagugaccaaccuaucccaaccacacaagaauucucuugccucuguggacccacccucuggccaggaucccucccucacagagaucuugcuuacugaccuaaagccugauacucaguacaaugccaccaucuauucucaagcagcaaauggcacugaaggacagcccaggaacaaaguguuuaaaacaaauuccacccagguuucugacguccgagcuaugaacaucagugccucaagcaugacccugaccuggaaaagcaauuacgaugggucccguacuucaauugucuacaaaauacacguggcugggggggaccacuccgucaaccaaacugucaauaagacugaggccaucauccucggacucagcuccagcaccuuguacaacaucacaguucauccuuuccugggucagacggagggcacaccaggcuuccuccaaguguacacuucccccgaucaggucucugacuuccgagugacaaaugucagcacaagggcaauugguuuggcuuggaggagcaaugacuccaaguccuucgagauuuucaucaagcaggacggaggugagaagcaucgaaaugcuucgacgggaaaccagagcuauaugguugaagauuuaaagccuggaaccaguuaccauuuugagauaauuccacgaggaccagacgggacagaagggcuguccaguacagugaaugggagcacugaccccagugccgugacugacauccggguggucaacauuagcaccacugaaaugcaguuggaguggcagaauacggacgaugccucuggauacacuuaccauuuaguucuagagucuaaaaguggcuccaucaucaggaccaacaguucucagaaguggaucacaguagggagccucaccccaggcaccuuauacaaugucacaaucuuuccagaaguggaccagauccagggaaucuccaacuccauuacccaguacacacggcccagcagugugucccacauugaaguaaacaccaccaccaccacggcagccauccgauggaagaacgaggacacagccucugcuuccuaugccuacuccguccuuaucuugaagacuggagauggcagcaauguaaccagcaacuucacaaaagacccuucuauucuaaucccugaguuaaucccuggcgucucuuacacagugaagauccuuacacaaguuggggaugguacaacaucacugguaccugguuggaagcuguucuguacggaaccugaaucagugaccuccuuccacugugaaguggucccuaaggagccagcauugguucucaagugggccugccccuuuggcauguacacaggcuucgagcugggggucaggagugauuccugggacaauaugacacgccuagagaacugcacaucggaugaugacacagagugcaggacggaagucgccuauuugaauuuuucuaccucguacaacaucagcaucgccaccuugucaugugggaagauggcgcuucccgcccagaacaucugcaccacuggcaucacagacccaccuacuccggauggauccccuaauauuacaucggucagucacaauucaguaaagguuaaguucagcggguuugaagccagccacggaccuaucaaagccuaugcugucauccucaccaccggggaagcugcccaaccuucugcagauguuuugaaguacacguaugaggauuucaaaaggggagccucggauacuuaugucacauaccucauaagaauagaagagaagggacagucucagggcuugucugaagucuugaacuaugaaauugauguggggaaccaauccacuacccucggcuacuacaacgggaggcuggagccucugggcuccuaccgggauuguguugcuggcuuuaccaauauuaccuacaaccuucagaaugacggccucaucaauggggaugagagcuaugugucuuucaguccauauucagaggccguguucuugccccaggauccaggugucaucugcggagcaguguuuggauguaucuuuggugcccuggccaucacagcugugggaggcuucaucuucuggagaaagaaaaggacagaugccaagaauaaugaaguguccuuuucucaaauuaaaccuaaaaaauccaaguuaauccgaguggagaauuuugaggccuacuuuaagaaacagcaagcugacucuaacuguggguuugcagaggaauaugaggaccugaagcugauugggauaaguuuaccuaaauacacagcugagauagccgagaacagagggaagaaccgcuacaacaauguucugcccuaugauauuucucgagucaaacuuucaguccagacccauucgacagaugacuacaucaaugccaacuauaugccuggcuaccauuccaagaaagauuucauugccacacaaggaccuuuacccaacacuuugaaagauuucuggcguaugguuugggagaaaaacguauaugccauuguuauguugaccaaaugcguggagcagggaaggaccaaaugugaggaguacuggccuuccaagcaggcucaggacuacggggacauaacuguggcgaugacaucagaagucguucuuccagaauggaccaucagagauuuuguggugaaaaauaugcagaauagcgagagccauccucugcggcaguuccauuucaccuccuggccugaccacgguguuccugacaccacugaccugcucaucaacuuucgguaccugguccgggauuacaugaagcagauaccccccgagucaccaauucuggugcauugcagugcugggguuggaaggacgggcacuuucaucgccaucgaucgccugaucuaucagauagagaaugagaacaccguggacguguaugggauugucuaugaccuucggaugcacaggccucugauggugcagacagaggaccaguauguuuuccucaaucaguguguuuuggauauuaucagagcccagaaagacucaaaaguugaucucaucuaucagaacacaacggcaaugacaaucuaugaaaaccucgagccaaguuccuugaaugugacuauguugcuucauccacagcugaacgauuuuggauguuggguucuagguccuggcuguugcuggucugcuaggauccagggccuuguugacaucugggaagauguaaauugucccgcugaaggccgcaguuuuagauguggccacuagauggagccagagcacugguaugaaggagcaccagggccguguaaggcaaaagaggacccagaaaaagaaacuuaacuuguucacuccugagaaaccugcaagucaacaagccaaggaagugccuuugcaugcauuugguagccuuuccaaucccgcuuauuacauaauauguucauguucauggcaaaaaaaaaaaaaauaaaauaaaauaaauaaaaaaggaaaacaaaauaaaaaaaaucuuagaacauu

SEQ ID NO: 186 - RNA, 249 nt, Homo sapiens
gcccccucaagggcauccugggcuacacugagcaccagguggucuccucugacuucaacagcgacacccacuccuccaccugacgcuggggcuggcauugcccucaacgaccacuuugucaagcucauuuccugguaugacaacgaauuugcuacagcaacaggguguggaccucauggcccacauggccuccaagguaagccccuggaccaccagccccagcaaggcacaagaggaaggagagacccu

SEQ ID NO: 187 - RNA, 410 nt, Homo sapiens
uuuuuuuuuuuuuuuuucauauuaaacuuguaguuuuauucagguuugauuuuuaacaaaugugucagggagagagcccacaggaaaggguaaagcccgugggggcaaggccuucccagaugccugaggagggaucguguccccucccccccuccucuucucaccaccccuacagggguuugggaagagacacaggcagggaaggggcugguccccagucuguacaguggugcuugggggugaaggacuauggagaacaggggaccagaucggggaugaguaggauaaagggcacaagaccauuuaccagaauccagcuuucugauuccaaauugaauuaaaaagaaaaaaaggagaggggaaccuaaaccacaagcaguacccaacucccuuucccccaucagggcugc

SEQ ID NO: 188 - RNA, 382 nt, Homo sapiens
uuuuuuuuuuuuuuuuuagggaagaggcugaugccagauaaguuuuuauuauauuaaaaaaaaaaaaaaaaccagugcaacuggaaaucagggugagucgcuggaggugagugagagucggaaggcccuccacaccucagugguggcaggaucuggacccguagccuaagccuggucugauccagccgagaugcuggaaagcagagcacacgguggugcccaucagggcaaagagggcaagagagcccacggcuccuccauaccgcuugcuagggucuccuguguaguagccauaugcguaaaggacucgcccaauaauccaggccaggcccaggccagaagcuaugcgcgggugguaaacaccucccaccguuaggaaaaa

SEQ ID NO: 189 - RNA, 253 nt, Homo sapiens
  misc_feature (32)..(32): n is a, c, g, or u
  misc_feature (41)..(41): n is a, c, g, or u
cggccgcgugaguuuugacugagcuucugcangaaguucanaugcaacuccauacaucaguucauuuucuagcauuaccacuggguuauuaucacgaauggccgauuuaauaaguccuuuugcauccucggaauuccaggggcugaccacuuuuaaaccugggcagugcccauaccaugcagcaaagcauugcgagugcugagcagcuacaccugcugaggcgccauugggcccccugaauacuaugggcaca

SEQ ID NO: 190 - RNA, 371 nt, Homo sapiens
uuuuuuuuuuuuuuuuugaagggccauuggaguuuauuuacagacaaccuuaggugaggccuuuuccucuaggaucuacaugcuuuugaaguuacuugguuucaggcuucuugucuccagcuucgagcuugagacucucaggaggcuggcgauaggcagggaaagccucccaggggcuguucaggucaaacuugcggaauucuugugccagcuccacugguucagccacuacccgcuuuaccucaucgucguaacgaagcucaacauagccagugaggggaaagucuuuccggaaaggaugucccucgaagccauaaucugucaggauccuucuuaaaucagggugguuaaaaaaaaaaaaaaaaaaaaaa

SEQ ID NO: 191 - RNA, 324 nt, Homo sapiens
uuuuuuuuuuuuuuuuuggggggcagcgaacuuuauugaugguauucaaaaaaauagggagggcucccuaggcccccccuguuauuaugggggucugggauggaaauuuugagggaaaugcucaauuuugggggcccauuugggaaaaggccccccuugcccaauguccuugcuggggugggugguccaagguuucuuacuccuuggaggccauuuuggccaagagguccaccacccuguugcuguagccguauucauugucaaaccaagaaaugagcuugacaaauuugucauugaaaaaaaugccaaccccggaaucaaagg

SEQ ID NO: 192 - RNA, 2110 nt, Homo sapiens
gcuccucaucucacucgggccuaugccaaagauguaaaauuuggugcggaugcucgagccuuaaugcuucaagguguagaccuuuuagccgaugcuguagcuguuacaauggggccaaagggaagaacagugauuauugaacagaguuggggaagucccaaaguaacaaaagauggggucacuguugcaaagucaauugauuuaaaggauaaauacaaaaauaucggagcuaagcuuguucaggauguugccaauaacacaaaugaagaggcuggggauggcaccaccacugccacuguucuggcacggucuauugccaaggagggcuuugagaagaucagcaaaggggcuaauccaguggaaauccggagaggugugauguuggcuguggaugcuguaauugcugaacuuaagaaacagucuaaaccugugacaaccccugaagaaauugcucagguugcuacaauuucugcaaacggagacaaagacauugggaacaucauuucugaugcaaugaagaagguuggaagaaagggugucaucacagugaaggauggaaaaacccugaaugaugagcuagaaauuauugaaggcaugaaguuugauagaggauauauuuccccauauuuuauuaacacaucaaaaggucaaaaaugugaauuccaagaugccuauguuuuguugagugaaaagaaauuuuccaguguucaguccauugucccugcucuugaaauugcuaaugcucaucggaagccauuggucauaaucgccgaagauguugacggagaagcucuaagcacgcugguuuugaacaggcuaaaaguuggucuucagguuguagcagucaaagcuccaggguuuggggacaacaggaagaaccagcuuaaagauauggcuaucgcuacugguggugcgguguuuggagaagaggguuugaaucuaaaucuugaagauguucaagcucaugauuuagggaaaguuggagaggucaucgucaccaaagaugaugccaugcuuuugaaaggaaaaggugacaaagcucacauugaaaaacguauucaagaaaucacugagcagcuagacaucacaacuagugaauaugaaaaagaaaagcugaacgagcgacuugcuaaacuuucagauggaguagcuguguugaagguuggaggaacaagugauguugaagugaaugagaagaaagacagaguuacugaugcucucaaugcuacaagagcagcuguugaagaaggcauuguucuaggagggggcugcgcucugcuucggugcaucccagccuuggauucauuaaagccugcuaaugaagaccagaaaauagguauagaaauuauuaaaagagcacuuaaaauuccugcaaugacgauugcuaagaaugcagguguugaaggaucuuugauaguugagaaaauucugcagaguuccucagaaguugguuaugacgccaugcuuggagauuuugugaacaugguggaaaaagggaucauugauccaacaaagguugugagaacugccuuacuggaugcugcugggguggccuccuugcuaacuacagccgaagcuguagugacagaaauuccuaaagaagagaaggacccuggaaugggugcaauggguggcaugggaggggguaugggaggcggcauguucuaacuccuagaguagugcuuugcccuuaucaaugaacugugacaggaagcucaaggcagguuccucaccaauaacuucagagaagucaccuggagaaaaugacugaagagaaggcuggcugaccacuguaaucaucaguuacugguuuccuuugacgauauauaaugguuuacugcugucauuguccaugccuacagauaauuuauuuuguauuuuugaauaaagaacauuuguacauuccugaugcugguugcaagagccauauaccaguguccugcuuucaacuuaaaucacugaggcaucucuacucuucugugagucaucaggacuguagcgcugugucaacaaaacauagagaguucagaagacagccuuucuguggaagggugggaaugauuguguacaaaguagagaaguauccaauuaugugacaaccuuuguguaa

SEQ ID NO: 193 - RNA, 1228 nt, Homo sapiens
acagccgcaucuucuugugcagugccagccucgucccguagacaaaauggugaaggucggugugaacggauuuggccguauugggcgccuggucaccagggcugccauuugcaguggcaaaguggagauuguugccaucaacgaccccuucauugaccucaacuacauggucuacauguuccaguaugacuccacucacggcaaauucaacggcacagucaaggccgagaaugggaagcuugucaucaacgggaagcccaucaccaucuuccaggagcgagaccccacuaacaucaaauggggugaggccggugcugaguaugucguggagucuacuggugucuucaccaccauggagaaggccggggcccacuugaaggguggagccaaacgggucaucaucuccgccccuucugccgaugcccccauguuugugaugggugugaaccacgagaaauaugacaacucacucaagauugucagcaaugcauccugcaccaccaacugcuuagccccccuggccaaggucauccaugacaacuuuggcauuguggaagggcucaugaccacaguccaugccaucacugccacccagaagacuguggauggccccucuggaaagcuguggcgugauggccguggggcugcccagaacaucaucccugcauccacuggugcugccaaggcugugggcaaggucaucccagagcugaacgggaagcucacuggcauggccuuccguguuccuacccccaauguguccgucguggaucugacgugccgccuggagaaaccugccaaguaugaugacaucaagaagguggugaagcaggcaucugagggcccacugaagggcaucuugggcuacacugaggaccagguugucuccugcgacuucaacagcaacucccacucuuccaccuucgaugccggggcuggcauugcucucaaugacaacuuugucaagcucauuuccugguaugacaaugaauacggcuacagcaacagggugguggaccucauggccuacauggccuccaaggaguaagaaacccuggaccacccaccccagcaaggacacugagcaagagaggcccuaucccaacucggcccccaacacugagcaucucccucacaauuuccaucccagacccccauaauaacaggaggggccuagggagcccucccuacucucuugaauaccaucaauaaaguucgcugcacccac

SEQ ID NO: 194 - RNA, 723 nt, Homo sapiens
agaagcuuccuaaggaacaagcaaguugaauagagaaaauagugaucaauaauaggcauuuuaguggucuuuuuaauguuuucugcugcggaacauuucaagauuuauugauuuccuccuccccccauuuuuuucccaccacacucacacacgcacgcucacacuuuuuauuugccauaaugaaccguccagccccuguggagaucucuuaugagaacaugcguuuucugauaacucacaaccccaccaaugcgacucucaacaaguucacagaggaacuuaagaaguacggagugacaacuuugguucgaguuugugaugcuacauaugauaaagcuccaguugaaaaagaaggaauccacguucuagauuggccguuugaugauggagcuccacccccuaaucagauaguagaugauuggcuaaaccuguuaaaaaccaaauuucgugaagagccaggcuguuguguugcagugcauuguguugcaggauugggaagggcuccugugcuaguugcgcuugcauugauugaaugcggaaugaaguaugaagaugcuguucaauuuauaagacaaaaaagaagaggagcauucaauuccaaacagcugcuuuacuuggagaaguaccgaccuaagaugcgguuacgcuucagagauaccaaugggcacugcuguguucaguagaaguagaagcaggcuggcuggaucguggcauuagagggaa

SEQ ID NO: 195 - RNA, 2690 nt, Homo sapiens
auucagguuccucacagacccagggggugaggauguugcuuuuugcccacuugcuucagcugcuggucagcgccacagucccgacccagaguaguaagugaggggaggggugaggggagggguugggagcgaaaaagacucugugaggaaaagcgggaggguggugguggcggaggugcagcaccccaaguuccgccgcccuguccuagucccucccccgccuuuaccugggaccuugagccugggggaggucggggucucaccgcgcgccgcccccaggcccacacucgcugcgguauuucaccaccgccgugucccggcccggccucggggagccccgguucaucauugucggcuacguggacgacacgcaguucgugcgcuucgacagcgacgcggaaaauccgaggauggagccucgggcgcgguggauugagcaggaggggccggaguauugggagcgggagacuuggaaagccagggacauggggaggaacuucagaguaaaccugaggacccugcucggcuacuacaaucagaguaacgacggugagugcggcugggaucacagcuaugaucacuccauguccccugagacgggccugggucaucuugacccgcugagacaaaguuucauccaaacgccuacccagaaccucagacaaaaaagcccccgcagaguucugcuuagguuugggguuguacuuuuguuucucuuuuguuuugagauaucuacuaacauugggcaaaguggccacagguggcgcucaucagcguaucccuuccagaaucucacacgcugcaguggauguacggcugcgacguggggcccgaugggcgccugcuccgcggguauugucaggaggccuacgauggccaggauuacaucucccugaacgaggaccugcguuccuggaccgcgaaugacauagccucacagaucucuaagcacaagucagaggcagucgaugaggcccaccaacagagggcauaccugcaagguccuugcguggaguggcuccauagauaccuacggcugggaaaugagacacugcagcgcucaggugcccuggagagcucuccucacuuuuccucugcgguuugggggaaauccuugagguauaaccucaggggcagaacgcuguucagcgggcacagcgcggaggaggagggagagggacucccaaaacugcuuuuccccuguagggauucuaauccuuaacaaaagcagaucaggcucgacaauggcccuggacccauggggggagggggcucuuucucaggccucccuccuugcccuacucagugucucuauagucagacuccagcuuuucucaaucucuuggcccucauccagcucaggaccagaagcccuucccaugagucugcagagaccuggagccuccuguccauguuguccugcucacauccuaaggcaucccuaagagcagauccucccaggugcaggugcucuagcuggugucuagaugauggacaccauaaucccaccgcaguccuccuguccaccccaggacggucacaugaacacugcugaguccccagaagaaagcaagaugccucauccuuucaacucucucccucagacccuccaaaggcacaugugacccaucacccuagaucugaagaugaagucacccugaggugcugggcccugggcuucuacccugcugacaucacccugaccuggcaguugaauggggaggagcugacccaggacauggagcuuguggagaccaggccugcaggggauggaaccuuccagaagugggcagcugucguggugccucuugggaaggagcaguauuacacaugccauguguaccaugaggggcugccugagccccucacccugagaugggguaaggagggugugggugcugaacuggggucagggaaagcuggagccuucugcagacccugaguuggucauggcucagagcugggaucauaacccucaccuucauuuccuguaccuguccuucccagagccuccuccauccacugucuccaacaugguaaucauagcuguucugguuguccuuggagcugugaucauccuuggagcugugguggcuuuugugaugaagaggaggagacacauagguaggaaagggcagggucugaguuuucucucagccuccuuuugcagugugcucugcuccuuaaugggaaacauagccacacccacauugcugcagucuccaacugggucagcugucaguuccgggaacucccuagggcugguguuucucuggucucucauggcuuuucuucucacagguguaaaaggaugcuaugcucauguucuagguaagugcgagagaggggcaggggacacccuugucccugaggcucucaggauggagcugggauuuguuccagcccauaaucuccucuugccacauccucucugucuccucugugugccuuguuaucucuucuacugcaggcagcaagagcuuccagaccucugacuggccucagaaggcaugaaaaucccugggggggcuggugagauggcucaguggguaagagcacugacugcucuucugaagguccagaguucaaaucccagcaaccacaugguggcucacaaccauccguaacgagaucugacucccucuucuggagugucugaagacagcuacaauguacuuacauauaauaaa

SEQ ID NO: 196 - RNA, 269 nt, Homo sapiens
uuuuuuuuuuuguucccuugaaagccagauguuccaaaaaguagccugcuccauuguucuucucagucucauagcgacugccagcgucaauccacacucccaccgugcagguagcaugcgaggacugcuccgaggccacacgcagcccguuguccaagaugcugaccugggucuccggcacgcucuggagggccugggcgaagguugcgguaccccgcaaggcagguaaccucagcagggccggcgagcggcgggugcgccucgugccg

SEQ ID NO: 197 - RNA, 1335 nt, Homo sapiens
ggugcuuaauguuuugaccuguagagguccucacuuuucgucauggcgcugaagguggcgauagcugcuggcggugcugcaaaggcaaugcucaagccaacucuccucugccguccuugggagguucuggcugcccauguggccccccgaaggagcauuuccucacaacaaacaauuccuccaucugcuaaguauggugggcggcauacagugacuaugaucccaggggauggcaucggcccagagcucauguugcauguuaagucuguauucaggcaugcaugugugccgguggacuuugaagaggugcauguaagcuccaacgcugaugaggaggacauccgcaaugccaucauggccauccgccggaaccguguggcccugaagggcaacauugaaacaaaucauaaccugccaccaucccacaaaucucgaaacaacauccuucgcaccagccuagaccucuaugccaacgucauccacuguaagagccugccaggaguggugacccggcacaaggacauagacauccucauuguacgggaaaacacagaaggcgaguacagcagccuggagcaugagagcguagcaggagugguggagagcuugaagauuaucaccaaagccaagucccugcgcauugcugaauaugcuuucaagcuggcccaggagagugggcguaagaaagugacggcugugcacaaggccaacaucaugaaacugggugauggacucuuccuccagugcugcagggaaguagcagcccacuacccucagaucaccuuugacagcaugauuguagacaacacaacaaugcagcugguaucccggccucagcaguuugaugucauggugaugccuaaucucuaugguaacauugucaacaacgucugugcagggcuaguuggaggcccaggccuuguggcuggggccaacuauggccauguguaugcaguauucgagacagcuacaaggaacacaggcaaaaguauugccaauaagaacauugcuaacccgacugccacacugcuagcaagcugcaugaugcuagaccaccucaagcuccacuccuaugccacuuccauccgcaaagcugucuuagcauccauggacaaugaaaauaugcauaccccagauauuggaggccagggcaccacaucccaagccauccaggacaucauucgucauauccgcaucauuaauggacgggcuguggaggcuuagcuaucccuacaguuuugcucagcuugucuguaggacucucuucucacuuuagcacuccagcuagcuugggggacaggacccagaauaaagccacuucuguuccagaaaaaa

SEQ ID NO: 198 - RNA, 382 nt, Homo sapiens
uuuuuuuuuuuuuuuuuguucuuaauagaaaacuuuauuuucacugauaaugucacuguaacauaauuucauagcagaccugugcaaaagaucccacaucaccaaugucuccaagagauuucacacacuucugggcaggacgcacagcucugcccccacccccguguugacagucaacauuuuacccccgcuaugaguacagaaaggcgaggcaucauaacgaagccgccugaaggcagcgugagcugaagucggacgcuugccaccucugaaugaauggucaccacagcaacagcacaugguugccucagugugcucagggugggucuuugaaaaaacgucccacuauguaaauaugcugcacuuaucccuucaacauugu

SEQ ID NO: 199 - RNA, 1992 nt, Homo sapiens; identical to SEQ ID NO: 169

SEQ ID NO: 200 - RNA, 210 nt, Homo sapiens
  misc_feature (118)..(121): n is a, c, g, or u
gauccuguauauguguguuuugggggagcuaugauaaguuuuauggcaaacgguugguauuguuaacuuuuuauugucaucaaaaguucauaaaaguccuauuaauccccauauucunnnncugcccuuaacucugguauacaccaaaaagaaaucuuuacuuuccuuguuuuaucauuauaaaaauaaaguauuuugcuaguauggaaa

SEQ ID NO: 201 - RNA, 677 nt, Homo sapiens
aguccgcgucccggcgucggcccgucccgcaccauggugacgcucgccgagcugcuggcgcugcuggccgcgcugcuggccacggccucgggcuacuuugucagcaucgacgcgcacgccgaggagugcuucuucgagcgggucaccuccggcaccaagaugggccucaucuucgagguggcggagggcggcuuccuggacaucgacguggagaucacaggaccagauaauaaaggaaucuauaaaggagaccgggaguccagcgggaaguacacauuugcagcccacauggaugggacauacaaguucugcuuuagcaauaggauguccacuaugacuccaaagauaguaauguucaccauugacauuggggaggcucccaaaggacaagacauggagacagaagcucaucagaacaagcuagaagaaaugauuaaugagcuggcaguggcaaugacagccguaaagcacgaacaggaguacauggaaguccgggagagaauacacagagccaucaaugacaacacaaacagcagagugguccuuugguccuucuucgaagcucuuguucuaguugccaugacauugggacagaucuacuaccugaagagauuuuuugaaguccggaggguuguuuaaaaggccuuuuccuguugaucccaaauucaugauuuacu

SEQ ID NO: 202 - RNA, 2849 nt, Homo sapiens
  misc_feature (2158)..(2158): n is a, c, g, or u
gcauuggcucugggcugcggccggcucggcgacgcuccucgggcagcucacugcauggucgucuggugcccccgccgccugcauccccgccgccgccccgcgacgcccaccgccgccugcccugccgccgccgccugcgccgccucgggaccggcuguaugauuaggccacaaucuucaaugaguagacauauuccucaguucugugguguucucggucacacauuuauggaguuucugaagggcaguggagauuacugccaggcacagcacgaccucuaugcagacaagugaacuguagaaauucauuacuacuccaccaagaaacccccauaagaguggauaaccuggacacaggcguguugaauugaaaucugcacagcauuugagaagagcucagaccuggaugggguaaaccucagugccacuuccuuuguauugccucuaguauuacugggauugaagagucacugcuucuuguuuaggagguucauuucauuggcccguuucucccaauuucauacucaagcacugagaauuucaaguggaguauaucgaauaucgaaguagacuucagguuguuuuuugguuuuguuuuguuuuuuuuuuguuuugguuuuuuuuuuuuuuuucuguuuugguuuaaaucauuucuguauucaauuuuuuaauucuuucauaacccuauuggguguuuuuuuaaacuaaauuaacauggcucgaaugaaccgcccugcuccuguggaagucacauacaagaacaugcgauuucuuauuacacacaauccaaccaaugcgaccuuaaacaaauuuauagaggaacuuaagaaguauggaguuaccacaauaguaagaguaugugaagcaacuuacgacacuacucuuguggagaaagaaggcauucauguucuugacuggccuuuugaugauggugcaccaccauccaaccagauugucgaugacuggcuaagucuugugaagauuaaguuucgugaagaaccugguugcuguauugcuguccauugugucgcaggccuuggcagagcuccggugcuuguugcccuagcauuaauugaagguggaaugaaauaugaagaugcaguacaauucauaagacaaaagcggcguggagcuuuuaacagcaagcaacuuuuguaucuggagaaguaccguccgaaaaugcggcuccgcuucaaggauuccaauggucauagaaacaacuguuguauucaauaaaacuggggugccugaugccauugccuuggaaguggaacuucagaugggaccugauuugucaugcauauuacccaaugugucggcuuacugaauaagucuacugcagcuccacaggaauacugaaaaaccagucuuaccaggccacaaguuugacagaauugcaaccucuauauuugggcuaugaucaacauguuuggacacuuagcaaaagauuuuugcuguucagcauuuaaaaugugcuuauuauuuguaccaauugaccuuuccuaaaauaagguauugaguuaugucauuaaauguacuccugugccagaauauuauuagucuauaaggaauuuagaaggauuaggugccaaaauacccagcacaauacuuguauauuuuuagcaucauacagaaccaaaauugcaggaacugagaacucucagaccauccaugguguauuccuucagucauuucaaacacugcagggcuccucucguuaucugccugcucacucuguuuacaucucccacacuuaugccagaauacgucagguuugcuuagccauccuuuauuuuuuuuauuuuuuuuuuuaacuaagucuugcgcugauuauuuaauaugucugucucauuuuguuuuguuuugggaaaccucugucugaaaaaucaacuuuguuacagaagcacauaucuucaacaaugucuccagacaaaaagccuuauaguuaauuuaauguuugcacucagaagugcaaccuaacagggagggccugaaaaagaaacgagaggaggcuauuaaauauuuuuaguaauauguugccuuugucaugugcagaacauguagaguaugcucuuaauuuaguaaauauuuuuaagacauagagauacauguguagcuaacccauucuuauucaaaauucuggaauuuuguguuuuccnauaccuaucaggaaguuuccagcuuguuugaauuauggcuuuccucuucccaaucucuugcaaaaaagacaaagugggaugaaucugcuagugaacugagcagaaauguuuuauaacgccuuuugagcuauguaacuuaauaauuggauacuugaucauuuguuuuauuauguaaucggauaaaauggugauguguauuaaaguuaguucaaccauauauuuauacugucugggaaugugugguuauaguucugugggagaaauaguuugucaguguucaccagcuuguaaaaacuuaguaugagagcuucaacauuuaaauaaaugaugaaccgcauucgucacugaggacacuuuugccuaaaauuaacuuaauuuguagaaaacaauggauucaguuaauaucauuucaauuuauggaaaaaauuguuaggguugccaagugcuuuuuauuaaaaguuucucuuuaaaggucuagauaauugugaaucaguugaauguugggcaccgaggggaaacaguuuguaauagaugaucuagauuuuucaguucaguuccaucagucacuuguagcucugcaauuuccagaccaguuuucucauuuuuaaguucauuacaugccuguauauauuuugaaauuaacuugaaccugaguauuuggcacaugauggcuuaauaaauuuuaacuuuc

SEQ ID NO: 203 - RNA, 3023 nt, Homo sapiens
acgcuccccaaccuccaccuccccucgcucggccucuauaugcucccgggcucccuaguguuggcuggaagugggugacuuagaggcuuaaaggaggggcgccuaaccacggaccacgugugugcgggggcgacagcgccgccgggguggggcugagcgcugcaagccggguucgccuugcagcgcaggagucagugggcguugcgccacgaucucucuccacuagcacuaugcucccgccccacucaccgccuuggaaagucacaggagaaggcgggcucuaagacccagcaggcaccauccuacuggcgccuucgauccgagacccguuuggacaccagggggcgaugccgacccucuauaaaagcgguccccgcgcgggccuggccauucgcgacccgaagcugcgcgggcgcgagccaguuggggcacugggugggcggcggcgacagcggcgccacgcgcaggcuggaggccgccgaggcucgccaugccgggagaacucuaacucccccauggagucggccgacuucuacgagguggagccgcggcccccgaugagcagucaccuccagagccccccgcacgcgcccagcaacgcccgccuuuggcuuuccccggggcgcgggccccgcgccgcccccagccccaccugccgccccggagccgcugggcggaucugcgagcacgagacgucuauagacaucagcgccuacaucgacccggccgccuucaacgacgaguuccuggccgaccucuuccagcacagccgacagcaggagaaggccaaggcggcggcgggccccgcggguggcggcggugacuuugacuacccgggagccccggcgggccccggcggcgcggucauguccgcgggggcgcacgggcccccucccggcuacggcugugcggcggccggcuaccuggacggcaggcuggagccccuguacgagcgcgucggggcgcccgcgcuacggccgcuggugaucaaacaagagccccgcgaggaggacgaggcgaagcagcuggcgcuggccggccucuuccccuaccagccaccgccgccaccgccaccgccgcacccgcacgcgucucccgcgcaccuggccgccccccacuugcaguuccagaucgcgcacugcggccagaccaccaugcaccuacagccuggccaccccacaccgccgcccacgcccgugcccagcccgcacgcugcgcccgccuugggugcugcgggccugccuggccccgggagcgcgcucaagggcuuggccggugcgcaccccgaccuccgcacgggaggcggcggcgguggcagcggugccggugcgggcaaagccaagaagucgguggacaagaacagcaacgaguaccggguacggcgggaacgcaacaacaucgcggugcgcaagagccgagauaaagccaaacaacgcaacguggagacgcaacagaaggugcuggaguugaccagugacaaugaccgccugcgcaagcggguggaacagcugagccgugaacuggacacgcugcggggcaucuuccgccagcugccugagagcuccuuggucaaggccauggcaacugcgcgugaggcgcgcggcugcgggaccgccuugggccggcccccuggcuggagacccagaggaugguuucgggucgcuggaucucuaggcugcccgggccgcgcaagccaggacuaggagauuccgguguggccugaaagccuggccugcuccgcguguccccucccuuccucugagccggacucggugcgucuaagaugagggagucaggccguggugguuucuccuugagaccgagagacuuuuccgcggagcugagcugggggcccggcaguacuaguauuaaggaaguaaccuugugccuuggauacucaaaacucgcuccuuuuccuaccgaguagggggagcaaaaaugugccuugauauuuuauuuggaggauuccugcuuccucucgggccucagcuggcccccgugagaaaaaugaagggugcaggcccagggcaggaggaagauacaggaagcugagaucccggcagugcccugagcugccccucagucccugucuuuagaggggagggacuuagguguuggggauuugagucuguguccucacccccagcuacagggagguggagggcuccuaaucccuugcuuuuugcaccuccaccuacauccccccccccccacucagcuuacaacaggccagguuuccugggugaguucauggagaaugggggcaccacccccagucagacagaaagcugaguugugaguuagccaugugguaggagacagagaccuagguuucugggcuuuguggggugggggauaggaggacacggggaccauuagccuuguguguacuguaugucgccagccgcuguugcugaaggaacuugaagcacaaucgauccaucccagagggacuggaguuaugacaagcuucccaaauauuuugcuuuaucauccgauaucaacacuuguaucuggucucugugucccagcggugccuugugcaauggcagugugcacgucuaugcuaaaccaccauuuuauuuggucuuuuguuuuguuuugguuuugcucugauucuugccaaacugagacucuucacuaacggcugggggaaggagcugagugaggcucucauucuuuuugguuuagggauguuuggguuuuuucgucugccucccagaggaccaaugaaaugaagugggcuucccccucuccccuaguuguccaaggguguauguaguagugggucuuagcuuccuccggcuaagacuuaggcuuccccacccacccaaccccauccccaacggcccuggcucugggucuggaaagaaggccaccuccagccaguucauacacacaccccuguggcugggagcagggcuggaccgcuuccuucucuucuuuuuuuggggggggggacacaaaguuucaugcuagaugucguauguauuauaucuauaauauaaacauaucaaacucaa

SEQ ID NO: 204 - RNA, 380 nt, Homo sapiens
  misc_feature (76)..(76): n is a, c, g, or u
gaagcucagugucgugaaauggaaaccaaaccuuggagccaucgcugaguauaaaaaaaaggaagauuuauauucngcaaagaguagccgaacuggacaaaauuacuucugaaagagauaauuuuagacaagcauaugaagaucuucgaaaacaaaggcugaaugaauuuauggcugguuuuuacguaauaacaaauaaacuaaaagaaaacuaccagaugcucacauugggaggagaugcugaacuggagcuuguggacaguuuagauccuuuuucugaaggaaucauguucaguguucggccaccuaagaaaaguuggaagaagaucuuuaaccucucaggaggcgagaaaacccuuaguuccuggccuuaguguuug

SEQ ID NO: 205 - RNA, 1391 nt, Homo sapiens
gccgguuugaguugugcgcucgggugucccuuuccucuuccccucccgcagggcuugcggccaccauggcguauuagaggcagcagugccugcggcagcguuggccuuugcagcggcggcagcagcaccaggcucugcagcggcaacccccaccggccuaagccauggcgcucuucacgaaauccagcagcaguguugcuguaacggacaaagauaccuucgaguuaagcacauuccuggaauccagcaaagccccacaacaugaccgagaugagcuuccugaacagcgaaguguuggcgggggacuugaugucccccuucgaccagucggguuugggggcugaagaaagccuaggucucuuagaugacuaucuggagguggccaagcacuugaaaccucauggguucuccagcgacaaggcgggcuccucggaauggccggcuauggaugauggcuuggccagugccucagacaccggcaaggaggaugccuuuuccgggacagauuggauguuggagaaaauggaucugaaagaguuugacuucgaugcucuguuucgaauggaugaccuggaaaccaugccagaugagcucuugaccacguuggaugacacaugugaucuuuuugccccucuaguccaagagacuaauaaggagcccccucagacagugaacccaauuggccaucucccagaaaguuuaauaaaagucgaccagguugcccccuuuacauucuugcagccuuuccccuguuccccagggguucugucuuccacuccagagcauuccuuuaguuuagagcuaggcagugaaguugauaucucugaaggagacaggaagccugacucugcugcuuacauuacucuaaucccuccauguguaaaggaggaagacacucccucugacaaugacaguggcaucuguaugagcccggaguccuaccugggcucuccccagcauagccccuccaccuccagggccccaccagacaaucugccuucuccaggugguucccgugggucuccucggcccaaaccuuaugacccaccuggaguuaguuugacagcuaaagugaagacugagaaauuggauaagaagcugaaaaagauggagcaaaacaagacagcagccacuagguaccgccagaagaagcgggcugagcaggaggcccucacuggcgaguguaaggagcuagaaaaaaagaaugaggcucugaaagagaaggcagauucucuggccaaggagauccaguaucugaaagaccugauagaagagguccguaaggcaagggggaagaagagaguuccguaauaggguagucaggugcuuugugcuuguacauagucuuguguugcuguguuugcuguaauaaauuauuuuguagugaaagu

SEQ ID NO: 206 - RNA, 356 nt, Homo sapiens
uuuuuuuuuuuuuuuauguagggaaguucauauuuuauuuguccagugacauuuuuuacaguugaauacaaguuaaaggccugcuugcacaccaaagccagguccuuugggugguucagucaaagaaguaaggccuccagcuggcucacaacagaagcggccacuccuuggcccugguuugggaacuuuuccagcuuugaguucaucaauaaucucuucaauauccuugggugucagauccucauaguaguugucauuuauuugaaccaucggugcauuuacacaggccccuaaacauuccacuucuauaagagugaaaaguuugucagguguagucucuccaaccuuuauuccaa

SEQ ID NO: 207 - RNA, 413 nt, Homo sapiens
uuuuuuuuuuuuuuuuuggggugaauauagccaaguauuccauuuauuaacaaaauagucuuagcaagggagagcucuguucaccccacaagaggccccgcagccgaggccggcccgaagccccagcgcugcugcguaagaccgggagggagggaagguguuggggagaagacuuguauuaagucuuuaauccuagccaccgcaggaacccacggaaaccuaaugccagcuuuggcgauugcuggcucaggucugggacauggcgaagggagugcucugauccuagggcucccugaguccccagccugcccccaacagagcuccuaaaguugucuggucugcugacuugaggacugguaagcuuuggagggauccaucaaggauuccccgaccccaccccuaucgccagggga

SEQ ID NO: 208 - RNA, 1707 nt, Homo sapiens
ccucugcggcgcgguccucggagcggcgcgguucucggagccacgcgucugucuuccuccguggucauggcggacuaccugauuagcggaggcaccucuuacgugccggacgacgggcucacagcgcagcagcucuucaacugcggggacggccucaccuacaaugauuuucucauucuuccuggguauaucgacuucacugcagaucagguggacuugacgucugcucuaacuaagaagauuacacuaaagaccccauugguuuccucacccauggacacugucacagaggcuggaauggccaucgcgauggcgcuuacaggagguauugguuucauccaccacaacugcacaccugaauuccaggccaaugaaguucggaaagugaagaaauacgaacagggauucaucacugaccccgugguccuuagccccaaggaucguguacgcgauguuuuugaggccaaagccaggcauggcuucugugguauccccaucacagauacaggccggauggggagucgauuggugggcaucaucuccucaagggacauugauuuccucaaggaggaagagcaugaccgguucuuggaagagaucaugacuaagagggaagauuugguggucgccccugccggcgucacucugaaagaggcaaaugagauucugcagcgaaguaaaaagggaaaguugcccauugugaaugaaaaugaugagcugguagccaucauugcccggacagaccuaaagaagaaucgugauuacccccuggccuccaaagaugccaagaagcaacugcuguguggggcagccauuggcacucaugaggaugacaaguauaggcuggacuuacuggcccuugcugguguggauguagugguuuuggacucuucccagggaaacuccaucuuccaaaucaauaugaucaaauacaucaaggagaaguaucccagucuacaggucauuggaggcaauguagucacugcugcgcaagccaagaaccucauagaugcagguguagaugcuuugcgagucggcaugggaagugguuccaucugcaucacccaggaaguguuggccugugggcggccccaagccacagcaguguacaaggucucugaguaugcccgucgcuuugguguuccuguuauugcugauggaggaauccaaaaugugggucauauugccaaagcuuuggcucuuggggcuuccacagucaugaugggcucccuccuggcugccaccacugaggccccuggcgaguacuucuucucagaugggauccggcugaagaaauaccgagguauggguucucuugaugccauggacaaacaucucagcagccagaaccgauacuucagugaagcugacaaaaucaaaguggcccaaggaguuucaggggcagugcaggacaaggggucuauccacaaguucguuccuuaccugauugcuggcauccagcauuccugucaagacauuggugccaagaguuuaacccaagucagagccaugacguacucgggggagcuuaaauuugagaagaggacauccucugcucagguggaagguggcguccacagccuccauucguacgagaaacggcuuuucugaaaacagauccaguauaugccuugaauuuuucaauaaaaguuugggaaaaaaaaagugaaaaaaaaaaaaaaaaaaaaaaaaaaaaaaaaaaaaaaa

SEQ ID NO: 209 - RNA, 261 nt, Homo sapiens
gugugggugcagagcuggggucagggaaagcuggagccuuuugcagacccugagcugcucacggcugagagcuggggucauuacccucaccuucauuuccuguaccuguccuucccagagccuccuccauccacugucuccaacauggcgaacguagcuguucugguuguccuuggagcuuggccaucauugcagcugugguggcuuuugugaugaagagaaggagacacacagguaggaaagggcagagucugaguuuuu

SEQ ID NO: 210 - RNA, 173 nt, Homo sapiens
acaggaggggaaggccaaagcaagaaugaaagucccccgccccguaucaccacgggcacucggggucacccucaggaacaugcagucucugcacgugaggaaagaaacacgcagagauggacgagcacuuuuacacccuaauaaaauuagaugcacuaaccacagaccccccu

SEQ ID NO: 211 - RNA, 494 nt, Homo sapiens
uuuuuuuuuuuuuuuuuaaaaaaaaaaauggcaucuuuuauucaucaaucccuguuacacacugaaauacaugcaucuuucuuauguuacuuagcaacguccuuucuauccuuucacccauaaaucagucugaugaauucaucuuuaaauucaagaaguuuuucuuuuugaaacgcuacuuacauuuuauugucucaauaucaaagccaaucuagagauuuauucuuccuacaggugaaauagauguuaauacgggaacagucaguacauguucaagaugacaucaaaguuaugcccuaagcagauauuucaaggcaauaucaugccacuagcucugagacucuaaguaucacugauaguacuaaaagguagaagucagcuucaaaaacacacucuugcaauggacacugcucaugaugucuaagauuguucacucccacagucaugauuucagaugcacaguuuuuuuugcuuuccugagcauucgguuugac

SEQ ID NO: 212 - RNA, 384 nt, Homo sapiens
uuuuuuuuuuuuuuuuuaagagugucaccaaagcuuuauuuacaugcgucaucaucucuuuuacaaacuagauuaugguuuuaaauggaauacacaggcaauaucuacaaacgccacgggaaguacgcaccuccauuccaccgggaaggggcagauucccaaaucaaacugguuuugauccuugagaagaaaggcggcagagcuaacucacggcagcguaugguuagacaagguccucaguacccagaaugcagcaggauugcgucugccucaaaccagacgaccaacugcugcagguguuuaaacauggccacgcgccacacgaaauucuaguuugugugggguagaagcaagaaaaaaaaaaaaccauggcgccucgugccg

SEQ ID NO: 213 - RNA, 982 nt, Homo sapiens
gguccggauaguaaacugcucccuuacaucuccuuaaauauaaaguaaggaaaaagaaaaaacucaguucggguaaccaaguucaacaaguaauccuuggggccgcugugguaucgccaaaaucuacauaguaucucuuauuaaaauguuuugacgaaaauguaacaauuacgguacuuaaugguaacaauguggcugaggaagcaauaguuaacaaagaggagcuaagcuaugcaacaaaccagauuucuauuggucacaaauuugaaguugagaccuguuauccaauuaccaaguacuuccgcauacaucaucauaggcauuugaagauuucaaccaaucaggagcauguuccuucuauaaaggaacccagaaccuaaccucugcauuuccuauuucuuuguagaaauggcucguacgaagcagaccgcucgcaaguccacuggcggcaaggccccgcgcaagcagcuggccaccaaggccgcccgcaagagcgccccggccaccggcggcgugaagaaaccucaccgcuaccgucccggcaccguggcgcugcgcgagauccggcgcuaccagaagucgaccgagcugcugauccgcaagcugccguuccagcgccuggugcgcgagaucgcgcaggacuucaagaccgaccugcgcuuccagagcucggccgucauggcucugcaggaggcgagcgaggccuaccuugugggucuguuugaggacaccaaccugugcgccauccacgccaagcgugucaccaucaugcccaaggacauccagcuggcccgccguauccgcggcgagcgggcuuaauaggcacgcuuucuacacuggcacguaaaccaaaacggcucuuuuaagagccaccuccauuauccaccaaagaugcuugaaguacaaguugugagaguuuucuaggguuuccuauuauagccuuucuugacaaugugagcaccacccgacgaagcagucugag

SEQ ID NO: 214 - RNA, 424 nt, Homo sapiens
uuuuuuuuuuuuuuuuuggacuucugcggcuuuuauuuuugcauguaaaccacuggggggagggggaucuugauggugggcacccuagagauuacacuggaguuccgagggcuccagacacuagcugggaagucaggugacagaaacaaugauucagaccaaucacaugauugcaaaacugggucuccagcagggauucugguggucagguguggaugccuaaggaagcagugacaugggaggggcacgcacugggcuggccuugagcugcugggaugacaucagggauagaggaccuagcagcugguggcuccagggaucuccgguccaugcuuuauuuggccaggggguuccugaaggaccugccagcaaacuuggcuuugcugcccagcucuuccucaauucugaggaucugauuguacuu

SEQ ID NO: 215 - RNA, 1407 nt, Homo sapiens
auucuaaggaucaugucugcgagucaggauucucgauccagagacaauggccccgacgggauggagccggaaggcgucaucgagaguaacuggaacgagauuguggauagcuuugaugacaugaaucucucagagucccuccuccgugguauuuaugccuaugguuuugagaagcccucugccauccagcagcgagcuauucuuccuuguaucaaggguuaugaugugauugcucaagcccagucugggacugggaaaacagcuacauuugccauaucaauucugcagcagauugaauuagaucuaaaggccacucaggcuuugguucuggcacccacacgugaauuggcucagcagauacaaaaggugguuauggcauuaggagacuacaugggugccucuugucaugccugcauugggggcaccaaugugcgugcugaggugcagaagcugcagauggaagcuccccauaucaucguggguaccccuggccggguguuugacaugcuuaaccggagauaccugucccccaaauacaucaagauguucguacuggaugaagcagaugaaauguuaagccgaggguucaaggaucagaucuaugacauauuccagaagcucaacagcaacacacagguaguuuuguugucugcuacaaugccuucugauguccuugaggugaccaagaaauuuaugagagacccuauucggauucuugucaagaaggaagaauugacccuggaggguauccgccaauucuacaucaauguggaacgagaggaguggaagcuugacacauugugugacuuguaugagacgcugaccaucacccaggcagucaucuuuaucaacaccagaaggaagguggacuggcucaccgagaagaugcaugcccgagauuucacuguuucugccaugcacggagauauggaccaaaaggaacgagaugugaucaugagggaguuccggucuggcucuagcagaguauuaauuaccacugaccuguuggccagaggcauugaugugcagcaggucuccuuagucaucaacuaugaccuucccaccaacagggaaaacuacauccacagaaucggucgagguggucgguuuggucguaaggguguggcuauuaacauggugaccgaagaagacaagaggacucuucgagacauugagacuuucuacaacaccuccauugaagagaugccccucaacguugcugaccucauuugaggggcuguccugcgaccuggcccuagcccaggguucaguccugggguggggcuaaggaagagcuggaggggggaggggagggagccaagggauggacaucuuguuuuuguuuuggcuuuuuuuuuuuuuuguuucaguuuuuuuucucuaugaauaaaugucacuuuuugaggc

SEQ ID NO: 216 - RNA, 562 nt, Homo sapiens
uuuuuuuuuuuuuuuuugccaggauauauuuauuacugaaaguacaagcaacugagguuuacccugggaacacccacaaugaaacguguaucuucccuguuucucagaugcugccuccuuccacagagugaguuuucguuuaaaacucauaaugaggagaaggcagggggcuccaccccuuuccuguucaaucugaagacugaauugggcuacacugggauggagauuucaggugcugcaggucagugucaaccaaggguucgugugucaggaacucuggcugguaagaugacacaaaggcuucaugcugaagcucagggagguccagggagccuggcagaauggaaucaucauggucaucaucaaacgucugugucuggaaggcuucaaggcucauaauugcaucauucucuggcaguuccugagagagcugccccuuccuggguuugcacgcaucaaauuucacccacugguaauugacacaguuuugagcuucgggacaacucuuaaucagguuguggaugguuggaugagaaaacccaaagaagucggcaccgcauga

SEQ ID NO: 217 - RNA, 1238 nt, Homo sapiens
auuguaacagaagaaggaaaggaaaagaaaguuaacauugacuuugaaccuuucaaaccaauuaauacaucauuguauuugugcgacaauaaguuucauacagaggcucuuacagcguuacuuucagaugacagcaaguuugguuuuauuguaauagacggaaguggugcucuuuuuggcacgcuccaaggaaacaccagagaaguccugcacaaauucacuguggaucucccaaagaaacacggcagaggaggucaaucagccuugcguuuugcccguuuaagaauggaaaagagacauaacuauguucggaaaguagccgagacugcugugcagcuguuuauuucuggagaccaagugaauguggcugguuugguuuuagcuggaucagcugacuuuaaaacugaacuaagucaaucugacauguuugaccagagguugcaaucuaaaguuuuaaaauuaguugauauauccuaugguggugaaaauggauucaaccaagcuauugaauuaucuacugaaguucucuccaacgugaaguucauucaagagaagaaauuaauaggacgauauuuugaugaaauuagccaggacacaggcaaguacuguuuuggaguugaagauacacuaaaggcuuuggaaaugggagcuguacaaauucuaauagucuaugaaaaucuggauauaaugagauacguucuucauugccaaggcacagaagaggagaaaauucucuauuuaacuccagaacaagagaaggauaaaucucacuucacagacaaagagacuggacaggaacacgaacugauagaaagcaugccucucuuggaaugguuugcuaacaacuauaaaaaauuuggagcuacacuagaaauugucacagauaagucacaagaaggaucacaguuugugaaaggauuugguggaauuggagguaucuugcgguaccgaguagauuuccagggaauggaguaccaaggaggagaugaugaauuuuuugaccuugaugacuacuagguagucgacauggguccggcaaccgugccucacccuccagcauucaacccaaggagcauacccgugguggaguccaacagaucccugccuuacaauuggagcauuuccagaacuuaauccgugagcauuggauacugaaaagaaaagugaaacaaaaccagacccaacccuacacuuugguuugucguggugucagcgcagcagccgacaacuaagucucu

SEQ ID NO: 218 - RNA, 464 nt, Homo sapiens
cagaggagucauuguugcugugguggcuuuugugaugaagaggaggagaaacacagcguaagccagcugccuggaguggacuaagugacagacaaugucuucacacaucuccugugacauccagagcccucaguuuucuuuagucaaguaucugauguucccugugagccuaugggucaaagugaagaacugugcagcccagccugcccugcacacagaacccugucccugcacugcccuggguucccuuccacagccaaccuugcugcuccagccaaacacugggcgacaucugcauccugccagcuccaugcugcccugagcugcagcuccucacuuccacacugagaguaagaaucugaaugggaccuugauucuuaacauccugaccgaggguugauuucuuguuaauuucauggauugagaauacuuagaguuuugguuugucuugauuuuuuuucaag

SEQ ID NO: 219 - RNA, 841 nt, Homo sapiens
ugaauaaaaacgaggagccgaagauucuagggggcuacagcugcgcuuuugcagcacugaacaugguuccggguacucaagauauugcguuuguguuuggagagguguagauuguagauuccagccgagaagaccaggaaaagauaaggauaaagaaugucauauaucucaggagcuagaucacuucccgaugaacaaguaagaauugccucaacaaaaauggauggaauuggaccgaaaaaagccauucagcuucguuaucgauuagguaucagugggaacaucaagaugaaugaguuaacuaaguaucagaucgaccaaauugaacaaaugauagcucaagaucauguuguucauugggaauugaagaggggagaacgagcagacaucgaacgauuaauuucuauuucucguuaucguggaauucgucaucaagauggaucgcccuuacgcggucaacgaacucauacuaaugcaaggacugcucgcaagcaaauucggaaaugaaagaaggcuaccgaaagaacaagcaacggauuucgcgcucaucccuugcuaaagcgcauacguuuucuugcuccuugguacuugucugaucaaucacacuguucauuaguucacuugauuuuucguucgaugucuugaaccgcuuacuaaucacguauacguauaguaggcccccuucgccacuccacgucuggcccgucuuggucucgcucacuucgcccgccuaucguaucggcucggcuucguccgucaagcgacagcuucugccucugacggcuucacuaucgcucaugacugguaguacucuauguaguagucggccuuuguuaagcuu

SEQ ID NO: 220 - RNA, 136 nt, Homo sapiens
uauaaccauguuagaagcggaaguuggccugaaaaccugaggcuuaggcuucauagcugggcuguagauuggauuuaaacccaguuggagugcaaagucauggugugcucaaggugaugacagugaacagaguaug

SEQ ID NO: 221 - RNA, 752 nt, Homo sapiens
caugggccuccugagagauccuuagauccagguuagugcauaggaaaguguccccccacuaccuacagcuaagggauugggguggugggaucaugguggagggccguggugaauacuagcgaugucccccgcuacccgugcgucugccuccagggugccccuccaaccaggaugaggcucuucaucgcucuuccuguccugauuguggucguagccaugaccuuggaagguaagaaagagccuuggaagguaagaaagaugcuuggaagugugaaguuggccuugugccugcggcccaggcuuagaagacccucgaggagggcucugaggucccuuucugugucaucauuccacuaccgcccucccaucgucccccaucccaccugccaggugccuuauuuuugugucaaagugggugcugaaggaggcaacucuguccagaaaagacgcaguaaccaaugaccuaggauaccacccuuuggaauuggcuaaucuuccuagaaggggcggacgguaaaaacaaggaggugagaggugcaguaaaaucaaguguccaauacccucccccaugcuaaugaguuugcucgcaacccucucgcggcaggcccagcccccgcccaggcggccccggauuuguccggaacauuggagagcauaccggauaaacugaaggaguuugggaacacuuuggaagacaaggcccgggcagccauugaacauaucaaacagaaggaaauuuugaccaagacccg

SEQ ID NO: 222 - RNA, 2858 nt, Homo sapiens
cagcgccuggggcgcggcgggcgucggcccaggagacgcguggcggcgcucggccucgcggcaucggcggcugccuggccguuggcggcgagcgcacuugcgccugcgcagcgggguccgugccccuccuccccugggcggcccccccacccccccggcggcgugugaauggcggccucggcggcagcgacugcagcggccucggccgcgacggccgccucggcggccucugguagcccagggucgggcgagggcucggcgggcggugagaagcguccggcugcuuccucagccgcggcggccucugcagccgcgucguccccugcggggggcgguggcgaggcgcaggagcuucuggagcacugcggcgugugucgcgagcgccugcggcccgagcgggauccucggcugcugcccugucuacauucggccugcagugccugccugggccccgcuacacccgccgcagcgaauaauucgggggauggcggcucggcgggcgacggcgcuaugguggauuguccagugugcaaacagcagugcuacuccaaagacaucguggagaauuauuuuaugcgugauaguggcaguaaggccucuucugauucccaggaugcuaaccagugcugcacuagcugugaagauaaugccccagccacuagcuauuguguggagugcucugaaccacuuugugagaccuguguggaggcucaccagcgggugaaauacaccaaggaccacacugugcgcuccacaggaccugcuaagacucgagauggagagcgaacagucuacuguaaugugcacaagcaugagccccucgugcuguucugugagagcugugacacacucaccugccgcgacugccagcucaacgcucacaaggaccaucaguaccaguuuuuggaagaugcagugaggaaccaacguaaacucuuggcuucacuggugaaacgucuuggggacaaacaugccacacuucagaaaaacaccaaggagguucgaagcucgauccgccaggugucugaugugcagaagcgagugcagguugaugucaagauggccauucugcagaucaugaaggagcugaauaagcggggucgaguucuggucaaugaugcccagaaggugaccgagggucagcaggaacgucuggagcgccagcacuggaccaugaccaaaauucagaagcaccaggaacacauuuugcguuuugccucuugggcucuggagagugauaacaauacagcucucuugcucucuaagaagcugaucuauuuccagcugcaucgggcccucaaaaugauuguggauccuguggagccucauggugagaugaaguuucagugggaucucaaugccuggaccaagagugcugaagccuuuggcaagauuguggcugagcguccugguacgaacuccacagguccugggcccauggcuccuccaagagccccaggcccucuaagcaagcaagguucuggcaguagccagcccauggaaguacaagagggauauggcuuugggucagaugaucccuauucaagugcagagccgcauguaucaggcaugaagcggucccgcucuggugagggagagguaaguggccucuuaaggaaggugccacgugugagccuugaacgccuggaucuggaccucaccucugacagccagccaccagucuucaaggucuuuccuggaagcacuacugaggacuacaaucugauuguuauugagcguggugcugcugcagcagcugcuggucaggcugggacugugccaccaggagccccuggugccccaccccuuccuggcauggccauugucaaggaagaagagacagaagcugcuauuggagcucccccggcugcccccgaggguccugaaaccaagccuguguugaugccucugacugaagguccuggugccgagggaccucgucuagcuucaccuaguggcaguaccagcucaggcuuggaggugguggcuccugagguuacuucagccccaguaagugggccagguauccuggaugacagugccacuaucugccgagucugccagaaaccaggugaccuggucauguguaaccagugcgaauuuugcuuccaccuggauugccaccucccugcccugcaggauguuccaggggaggaauggaguugcucacucugccacgugcucccugaccuaaaggaggaagauggaagccucagccuggauggagcagauagcacuggugugguagcuaaacucucaccagccaaccagcggaaaugugagcguguucuccuggcccuguucugccaugaaccaugccgucccuugcaucagcuggcuaccgacucuacauucuccauggagcagccuggugguacccuagaccugaccuugauucgugcucgccuccaagagaagcugucaccuccuuauagcuccccccaggaguuugcucaagaugugggccgcauguucaaacaguucaacaagcugacugaggacaaggcagauguucaguccaucaucggcuugcagcgcuucuuugagacacgcaugaaugaugccuuuggugacaccaaguuuucugcugugcugguagaaccaccaccauugaaccuucccagugcuggccuaaguucucaggagcucucuggcccuggugauggccccugaagcuggggcucuuguggucagcccaguccagcucuggucucuguauuuucaccccauacccuguccuuugguggccugacuccuguucuugcuggccccaucguccccucagucccucuucacaaaaugguuuuuacuucuguggauuuaauaaaaacuucacugagucaguuaaaaaaaaaaaa

SEQ ID NO: 223 - RNA, 420 nt, Homo sapiens
uuuuuuuuuuuuuuuuuaaaaauaauuucauuuuuuaauauucuguacaaaauuucucaaccuaugaaaauaaaguuugcaaaagucaaaguaguacaugggccugcccuggagccaggcccagccggaucuacacuauguacaggucucccagggugagccucagcuagggaaaagccacuaaggugccuacagagcaagagggugccaucgggccagugcagccucugcaauuuccagaucugccacuagaggucggcaugguccugauugcuugucaggcucacccucuggaagaccacagccaaugacaaagguccucaagggaaagcuuuggggucuagcuggaagugacgguggguccgccgcccaggcgcaggagcaucugcuggcaguccagcaguaaccggugaucgccaa

SEQ ID NO: 224 - RNA, 963 nt, Homo sapiens
uccgucguaaccuguugaguaacuauggaagacuauaucaaaauagagaaaauuggagaagguacuuacggugugguguauaaggguagacacagagucacuggccagauaguggccaugaagaagaucagacuugaaagcgaggaagaaggagugcccaguacugcaauucgggaaaucucucuauuaaaagaacuucgacauccaaauauagucagccugcaggaugugcucaugcaggacuccaggcuguaucucaucuuugaguuccuguccauggaccucaagaaguaccuggacuccaucccuccugggcaguucauggauucuucacucguuaagaguuacuuacaccaaauccuccagggaauuguguuuugccacucccggcgaguucuucacagagacuugaaaccucaaaaucuauugauugaugacaaaggaacaaucaaacuggcugauuucggccuugccagagcguuuggaauaccgauacgaguguacacacacgagguagugacgcugugguaccgaucuccagaaguguugcugggcucggcucguuacuccacuccgguugacaucuggaguauagggaccauauuugcagaacuggccaccaagaagccgcuuuuccacggcgacucagagauugaccagcucuucaggaucuucagagcucugggcacuccuaacaacgaaguguggccagaagucgagucccugcaggacuacaagaacaccuuucccaaguggaagccggggagccucgcaucccacgucaagaaccuggacgagaacggcuuggauuugcucucaaaaaugcuagucuaugauccugccaaacgaaucucuggcaaaauggcccugaagcacccguacuuugaugacuuggacaaucagauuaagaagauguagcccucuggauggaugucccugucugcuggucguaggggaagaucg

SEQ ID NO: 225 - RNA, 479 nt, Homo sapiens
uuuuuuuuuuuuuuuuuacuaggcaaagaauuuuauuaacccuuuccaaacuuuauucccaggcuucuucagcuuuauuugccgcaaagaaugaauuagguauagcgaaaacugaaaagagcugcaguguccgggggcuugggcuuaaaaauauuagagaucuagauuuuaucagauccauaauaaacaaaaaaauuuuaaaaagcagucaugauauaaaauagcagcuccuguaauuucugcaaguaucaccuucuucagaaguugcuucaauucaguuugccucauucuuagaagccucaucaaaauucuccaccagaucuggaacuucaucaucaucauccucuccaguagcaaggggugcuuuuccauccacagauuguuugggcagagcuucagccagucuccuuaaacuagucaggcugucugcaccaagcugguugaggaugcugggaagcauuucugucagcugcuuuguc

SEQ ID NO: 226 - RNA, 520 nt, Homo sapiens
uuuuuuuuuuuuuuuuuauucaugcuugccuagggauggggaauagaucauucaauaaaaacauacaguaaaaacaggggguggggagggggaaggcuuaucauguacaauguuuaaacuacaauagugauguaccuuaauuacuuccaugcacacaagucuaacauuacaaguuuuuaaaaaauaaacaccauuaagacuucuaggagcauuuuauaauaaauuccuaauuuuuucuuuguagauagaucaagcaccuccaaaauacagauuccuauacacagugagcacuuuacuuaacguacauggacagccucaggacgagcugacgucucggaucagcucggcaggcaacaaaccauagugccaaauggaaagaagggcaguugcaaauaaacuuaaaacuaaguuaacuuuuauaauuaaauacagaaaauauacugauuugcuaaaaauaaauaagaugugauguauuuaacacuucacuauaaagaaugaacaccaugacauccucgugccg

SEQ ID NO: 227 - RNA, 468 nt, Homo sapiens
agaagaaggaggagugggaccgcaagcaugaggaugcuaguagggaguaugagaaaggcaugaaagaguaugaaggaggaagaggggacucaucuaaaagggacaagucuaagaagaaaaagaaaguaaaagcaaagauggaaaaaaaguccacuccuucccggggcucgucauccaagucuucauccaggcaguugagugacagcuucaagagcaaagaguuuguguccagugaugagagcucuucaggcgagaacaagagcaaaaagaagaggaggcggacgaggacucugaagaggagcuagccaguaccccuccaagcucagaggacucugccucgggaucugaugaauaaaggagggaauucccaccccgucacagcuccagucucucacauaguccuuggauucugugccaucugaguaacugcucuugguggcuuccacugcccugaggcuuugagggaag

SEQ ID NO: 228 - RNA, 1740 nt, Homo sapiens
aucgucguaaucguuugcagacuucucgccgucgccuuguaagcuuugucuucgccuugcaagcuuugucuucaggguuggaaagaugagacauucaaagagaacuuacuguccugacugggaugaaagagacugggauuauggaacauggagaagcagcagcagucacaaaagaaagaagagaucacauagcagcgcccgugagcaaaagcgcugcagguacgaucacuccaaaacgacagacagcuauuaucuggaaagcagauccauaaaugagaaagcuuaucauagucgacgcuauguugaugaauacaggaaugacuacaugggcuacgagccagggcaucccuauggagaaccuggaagcagauaccagaugcauaguagcaaguccucugguaggaguggaagaagcaguuacaaaaguaaacacaggagucgccaccacacaucgcagcaccauucacacgggaagagucaccgaaggaaaagaucgaggaguguagaggaugaugaggagggucaccugaucugucagaguggagacguacuaagugcaagauaugaaauuguugauacuuuaggugaaggugcuuucggaaaagugguggaaugcaucgaucauaaagugggagguagacguguagcaguaaaaauaguuaaaaauguggauagauacugugaagcugcucaaucggaaauacaaguuuuggaacacuugaauacaacagacccccauaguacuuuccguuguguccagauguuggagugguuugagcaucgaggucacauuugcauuguguuugaacuucuggggcuuaguacuuaugauuucauuaaggaaaacaguuuucugccguuucgaauggaucauaucaggaagauggcauaucaaauaugcaaaucuguaaacuuuuugcauaguaauaaauugacucauacagacuugaagccugaaaacaucuuauuugugaagucugacuacacagaggcuuauaaucccaaaaugaaacgugaugaacguacuauaguaaauccagauauuaaagugguggacuuuggaagugcaacauaugaugaugaacaccacagcacauugguaucuacaagacauuauagagcaccggaaguuauuuuagcccucggguggucacagccaugugaugucuggagcauaggauguauucuuaucgaguauuaucuuggauuuacaguuuuuucgacucaugauagcagggaacauuuagcaaugauggaaaggauucuuggaccacuaccaaagcacaugauacagaaaaccaggaaacgcagauauuuccaucaugaucgauuagauugggaugaacacaguucugcuggcagauauguuucucggcgcuguaaaccucugaaggaguuuaugcuaucucaggaugccgaacaugagcuucucuuugaccucauugggaaaauguuggaguaugaucccgccaaaagaauuacucucaaagaagcccuaaagcauccuuucuuuuacccacuuaaaaagcauacgugauuuauaaacacagugcucugaaaggaaucuuacagacuguaucagucuagcuuuuaauuaaguuauuuuguauagcuuaauuuguaaaacauuuuauguuuuuuagaugcuuuauuaaauacauggccaaaccaaauaacaucuuucaguaauuauagaaugauuuauuuggaauaaaauuugugcuuaugaauguaaaaaaa

SEQ ID NO: 229 - RNA, 815 nt, Homo sapiens
ggacucgcgacaagcguccucagcgcgaagaggcggacucggaguccucgccuugagccuugcaucugagaaguuccagguacuuuguacaacugcaucccagaaccuguguguuuucagcaccuuuauaagugauggcugccaucaggaagaaacuggugauuguuggugauggagcuugugguaagacaugcuugcucauagucuucagcaaggaccaguucccagaggucuaugugcccacgguguuugaaaacuauguggcggauaucgagguggaugggaagcagguagaguuggcuuuaugggacacagcuggacaggaagauuaugacugccugaggccucucucuuauccagacaccgauguuauauugauguguuuuuccauugacagcccugauaguuuagaaaacaucccagaaaaauggacuccagaagucaagcauuucuguccaaaugugcccaucauccugguugggaacaagaaggaccuucggaaugacgagcacacgagacgggaguuggccaaaaugaagcaggagccgguaaaaccugaagaaggcagagauauggcaaacaggauuggcgcuuuuggguacauggaguguucagcaaagaccaaagauggagugagagagguuuuugagauggccacgagagcugcucugcaagcuagacgugggaagaaaaagucugggugccucaucuugugaagccuugugaacgcagccucaugcgguuaauuugaagugcuguuuauuaaucuuaguguaugauuacuggccuuucauuuaucuauaauuuaccuaaga

SEQ ID NO: 230 - RNA, 287 nt, Homo sapiens
uucaagaccgaccugcgcuuccagagcucggccgucauggcucugcaggaggcgagcgaggccuaccucgugggucuguuugaggacaccaaccugugcgccauccacgccaagcgugucaccaucaugcccaaggacauccagcuggcccgucgcauucguggggagagggcguaaauuaggguagugagugaauuuggaccccaaaggcucuuuucagagccacccacauuuucuauaaaaggcuguauaucgauaagcuuuuauaaaccccacucagcaacucc

SEQ ID NO: 231 - RNA, 945 nt, Homo sapiens
uuaugugauaaaaaaauucaacuugguauuaacuuaacuaagggccuuggugcuggugcuuugccugauguugguaaaggugcagcagaagaaucaauugaugaaauuauggagcauauaaaagauagccauaugcucuuuaucacagcagggauggguggugguacuggaacaggugcugcaccgguaauugcaaaagcagccagagaagcaagagcgguaguuaaagauaaaggagcaaaagaaaaaaagauacugacuguuggaguuguaacuaagccguucgguuuugaaggugugcgacguaugcgcauugcagagcuuggacuugaagaguugcaaaaauacguagauacacuuauugucauucccaaucaaaauuuauuuagaauugcuaacgagaaaacuacauuugcugacgcauuucaacucgccgauaauguucugcauauuggcauaagaggaguaacugauuugaugaucaugccaggacugauuaaucuugauuuugcugauauagaaacaguaaugagugagauggguaaggcaaugauugguacuggagaagcagaaggagaagauagggcaauuagugcugcagaggcugcgauaucuaauccauugcuugacaauguaucaaugaaaggugcgcaaggaauauugauuaauauuacuggugguggagacaugacucuauuugaaguugauucugcagccaauagagugcgugaagaaguggaugaaaaugcaaauauaauauuuggugccacuuuugaucaggcgauggagggaagaguuagaguuucuguucuugcaacuggcauugauagcuguaacgacaauucaucuguuaaucaaaacaagaucccagcagaggaaaaaaauuuuaaauggccuuauaaucaaauuccaacauuagaaacaaaagaauaugcuucaacugag

SEQ ID NO: 232 - RNA, 238 nt, Homo sapiens
ugaucaggucacauuccggugccuuccacccccuauggcacgggcgccccgccuugccauaccacagcucccuccaggcuuagaccuggcuucaccgcauuucaggugcuauaccccccccugcuuuuccccccauugcccuuaaaugccccucggccccuccauccccccggaacaggguggcacuugccacucucaggaccaccuugccaaggagaauaaaccgaauccuguugcu

SEQ ID NO: 233 - RNA, 341 nt, Homo sapiens
uuuuuuuuuuuuuuuuucacucaucacguuuauucagaagagaauacacccaauccucucaucucuggaaaguuuuguuccuagccaucauuaagaucaggaccccuguucuccccuuaaccccaggagaggaagcuuauagucuuuguagauauucugaaccucugaucacaaaggguuauaaaauagugaagggguuuggacuaggaaaggcacagacugaaaggaaucugccaggggacugaggccacagcucccccaggagucagaggaagggggaagucacguauuuuauagaaggccaagggccucagagcaagaguauuccuuugaagagcuca

SEQ ID NO: 234 - RNA, 495 nt, Homo sapiens
ugguggagcaggucucaggaaucucuucgcuucagcuucaaucauggccuguggucuggucgccagcaaccugaaucucaaaccuggggaaugucucaaaguucggggagagguggccucggacgccaagagcuuugugcugaaccugggaaaagacagcaacaaccugugccuacacuucaauccucgcuucaaugcccauggagacgccaacaccauuguguguaacaccaaggaagaugggaccuggggaaccgaacaccgggaaccugccuuccccuuccagcccgggagcaucacagaggugugcaucaccuuugaccaggcugaccugaccaucaagcugccagacggacaugaauucaaguuccccaaccgccucaacauggaggccaucaacuacauggcggcggauggagacuucaagauuaagugcguggccuuugagugaagccagccagccuguagcccucaauaaaggcagcugccucugcu

SEQ ID NO: 235 - RNA, 861 nt, Homo sapiens
gugguucuucggcgccagguucgcccgcuucugcccuuagguaacauucucuaaacugcguuucucucccaaucuuuugcaggcauuuggggacuuuuucuuuucuuuuuacuuucucuuuuucuuuugcacaagaagaagucuacaagaucuuuuaagacuuuuguuaucagccauuucaccaggagaacacguugaauggaccuuuuuaaaaagaaagcggaaggaaaacuaaggaugaucgucuugcccaggugucuuguucuccggccuggacugugauaccguuauuuaugagagacuuucagugcccuuucuacaguuggaagguuuucuuuauauacuauucccaccauggggagcgaaaagguuaaaaaaaagaaaaaaaucacaaggaauugcccaauguaagcagacuuugccuuuucacaaagguggagcgugaauuccaggaggacccaguauucgguuacuuaaaugaagucuucggucagaaauggccuuuuugacacgagccuacugaaugcuguguauauauuuauauauaaauauauauauauugagugaaccuuguggacucuuuaauuagaguuuucuuguauaguggcagaaauaaccuauuucugcauuaaaauguaaugacguacuuaugcuaaacuuuuuauaaaaguuuaguuguaaacuuaacccuuuuauacaaaauaaaucaaguguguuuauugaauguugauugcuugcuuuauuucagacaaccagugcuuugauuuuuuuuuaugcuauguuauaacugaacccaaauaaauaccaguucaaauuuauguagacuguauuaagauuauaauaaaaugugucugacaucaa

SEQ ID NO: 236 - RNA, 830 nt, Homo sapiens
cgaugaaggcggugagcccggugcgccccucgggccgcaaggcgccgucgggcugcggcggcggggagcuggcgcuacgcugccuggcggagcacggccacagccuggguggcucggcagccgccgccgccgcugcggcggccgcgcgcugcaaggcggccgaggcggcggccgaugagccggcgcugugccugcagugcgauaugaacgacugcuacagucgccugcggaggcucgugccuaccaucccgcccaacaagaaagucagcaaaguggagauccugcagcacguuaucgacuacauccuggaccugcagcuggcgcuggagacucacccugcuuugcugagacagccgccaccgcccgcgccaccucuccacccggccggggcuuguccggucgcgccgccgcggaccccacucaccgcgcucaacacugacccggugagaagccuuggcgggcacccugggcaucgcgggaaagguggcggggcggcgagauacggguggucuugcuccucucagggaaugacagccgcuucucccgucuccaccgagagccgccugcugggcuuggugauccacuggucccugagccgagggcgguugggcuuggagcccugcgucuccggagugucccuugcaucacaggaggcuuccccagcuucgggcucggguggggacucugcucaccugccuaguuuuccaggacgucuccugggugguggcgacacugugauaugcgcacucuaaccgcuuuuccccuugguguuggguugcuguuccaggccggcgccgugaacaagcagggugacagcauucucugccgcu

SEQ ID NO: 237 - RNA, 5560 nt, Homo sapiens
acuagucucgaccauguaccaucacggagacgacaccaacagugacaugaacagugacgacgacaugagccgaagugggagagaaaccccacccccucgaccaucucaugcuuuuggcagugagcgagaccuggagcgcaggggcagaagcagagauguggagccucgagaccgcuggccauacaccaggaaucccagaagcaggcugccucaacgggaucuuucucuuccugugaugucaagaccacauuuuggacuggacagagaugaugacagacguuccauggauuaugagucucgaucccaggaugccgagucauaccagaauguuguggaacucaaagaggacaagaagccucagaauccaauucaggacaaccuggagaacuacagaaagcugcucucgcugggaguccagcuugccgaagaugaccgacacucucacaugacacaaggccacucaucgagguccaagagagcugccuacccaagcaccagccgaggucucaaacccaugccugaggccaaaaagccaucccacaggcgugggaucugugaggacgagucuucucauggagugauaauggaaaaauucaucaaggauguggcucgcaaccccaaauccggaagagcaagggagcugaacgagcguccuccuccaagguuccccaggccuaaugauaacuggaaggacaguuccuccagcagaagagagucagugauccaggagagggguuaugaagggagcgcauuuaggggcggcuuccgguucaacgcagaccuggcuuccagaagcagagcucuagaaaggaagaggcguuaccacuuugauucugaugagcgggguucgggccaugagcauaaaagcugugugaggaagaagccuuuugaguguggugcugagaugagacaggcuaugagcaugggcaaccugaacagcccuuccuucucugagucgcagucaaucgauuuuggggccaacccauacgugugugaugagugcgggaggcaguucagugucaucucugaguuuguugagcaccagaucaugcacacuagggagaaccucuaugaauauggagaguccuuuauucauagcguggcugucaaugaggugcaaagaagucaggguggggggaaacgcuuugaguguaaggaauguggagaaaccuucaguaggagugcugcccuggcagagcaccgccaaauccaugcuagagaauaucuugcagaauguagagaucaggaggaugaggagaccaucaugccuagcccgaccuuuagugagcugcagaagauguauggcaaagauaaguucuaugagugcaaggugugcaaggagaccuuucugcacaguuccgcccugauugagcaccagaaaauccaugguagaggcaacucagaugacagagauaaugagcgugaacgcgaacgugaucgucuacgugcacgugcacgagagcagcgugagcgcgaacgugaacgggagcgugagcgugagcuuggggaacccuuucugaccuguccaaacuucaaugaguuucggaagauguacaggaaagacaaaaucuaugagugcaaaguguguggggagagcuuucuucaucucucaucccugagggagcaucagaaaauccauacuagaggaaacccauuugaaaauaagagcaggaugugcgaggagaccuuugucccuagucagucucuccgacggcgccagaaaacuuacagagagaagcuguucgacuuuaacaaugccagggaugcacugaugggaaacucagacuccagcgagcaucagaaaaaccguucccgaaggaacuucuuugagggcagaggauuugagaaacccuucguugaaucucagaagagucauacuauaacaagaccaccugaaaacaaagacgaugacaagccguucacaaucagugucaacccuaaugacaagcugaaacuccccaucauggaaaauggcucccagggcaaauccugugagaggucuguuauucauagcuugggcuccgcagaagcucagaagagucaugguggacugggguucaguaaaccaagaccaguggcagagucuagcacccagagcucaagcagcauuuacuaccccagagcacacucuggaggcaacaccuaugaaggaaaagaauacaaggacucuaucauccauagcuugccagcuccucgaccucugaaacgucauagagcaaaugaccauauucaaugugaugaggggggagaauccuccauuuauaucccagauauuauuaauaagggaaggaagauuccugccagagaagaugcuuaugaaggaaguagcagcagcaacuaccacacaccaaauguaucccgugcugagccuccaagucuuucuggagagucccaugacucuaagcaggaugucacguuuucaguucccagcucaaguguucgugaacaccagaaagcucgugccaaaaagaaguacauugagcccaggaacaacgagaccucuguuauccacucccuaccuuuuggugaguugcuugcaggucaccguagggcaaaguucuuugagugucaggaaugcggggaggccuuugcucguaggucugagcucauugagcaccagaagauucaugauagagaaagaccuucuggaagccgacauuaugagcgcucugucauccgcagccuugcgcccagugacccucagaccaguuaugcccaagaacguuucauccaagaacaagugcguaaauucagagcguuuggacaacgcucaacuaccagcaacaaccucaguguacagaaaaucuaugcccaagagacauuuaaugccgaggagccccaugauaaagaaacucauggucaaaaaauucaugacaaagagccauaugguaaggagcccaguggcaaggagccccauggugaugagccccaggacaaagaaccccuuguucaggagaugcgcagugaagagccccaugaugauaagccccauggccaggagccccaugaugauaagccccauggccaggagccccaugaugauaagccccauggccaggagccccacggugaugagccccauggccaggagccccacggugaugagccccaugacaaggaacccauugaucaggagaugcgcagugaagagccccacagugaagagucucauggugaugagccccauggugaagagucccauggccaggagaaaguugaagaugcuaccauucaggccucaguuucugaagagcaucagaaagaugacgcuggugaugcaaucuaugaaugccaggacugugggcugggcuuuacugaucucaaugaccucacaagccaccaggacacccauagcagaaaggcucugguugacagucgugaauaugcacauucugaaguucaugcccacuccgucagcgaauuugagaaaaaaugcucuggagagaaacuauaugaauguccaaaauguggggagucuuucauucacagcucguuacuuuucgagcaccagagaguucacgaacaagaccagcuguauuccguaaaggccuguuaugacgcuuucaucgcucuguugcccguuagaccaaggagaaauugcacuguugaaaggaauccugccguuucugggucagccauucgaugccgucaguguggacaaggcuucauucacaguucugcccuaaaugagcacaugagacagcacagagauaaugaaauaauggaacagagugagcuuucagaugagauuuucauucaaggccuagcccucacugaguaucaggggagugaaacagaagagaagcuuuucgagugcacaaucuguggggaaugcuucuucacugccaaacagcucggggaccaccacaccaaaguucacaaggaugagcccuaugaguaugggcccuccuacacccaugccuccuuucucaccgagccccucaggaagcacaucccacuguacgaaugcaaagauugcggccaguccuuccuagacgacacugucaucgcugagcgcaugguguuucauccugagcgagaaggugggucagaaauaguagcugccacugcccaagaggucgaagccaauguccucaucccacaagaaguacugcgaauccaggggucaaaugcagaagcugcugagcccgaaguggaggcugcagagcccgagguggaggcugcagagccugagguggaggcugcagagccuauuggagaggcugaagggccagauggagaagcugcugagccugauggcgaggcugagcagcccaauggagaggcugaacagccaaacggugaugcugacgagccagacggagccgggaucgaagacccagaagagagagcugacgagccugaggaagacgucgaagagccagagggagaugcagaugagcccgauggugcagacauugaagacccagaagaggaaggagaagaucaagagauugagguugaagaaccauacuacaacugucaugaaugcgcagaaacguucgcuuccagcucagccuuuggcgagcaucugaaaagucacgccagugugaucaucuucgagccggccaaugcuccuggagagugcucuggcuacauugaacgggccagcaccagugcagguggugcggagcaggcagacgacaaguacuucaaaugugaugugugcgggcaacucuucaacgaccgccucucccuugccagacaccagaauucucacacugguugaguaaccaggcugaagaaaagaagagcaaagccaaaccuucuucccagaaccagacccuuaauaaaucacaaagagagccuaaaccaacccauaaugucuauaagaaauucaccuuccuguauacauaccggacuucacaucaaagacuuucacucucaucacagacugaaaaaagaaaagacauugaacgcagggacucuuucaguuuuagcuguucccuauggaacaucaguguauauuugggaaagcuagagugaacaucuacaucuuccauuucaucuaaguaacuagauugagggaaaccuagugacaauuccagaccacagagguugccccagucgacuguaaaugauaccccuuucauacccuauacauaaugauuccugccauguauauaaaugagcaaaucagugauacauauauuuggauuuagugugcuauagaauuuacaguuuacucuacagagcuaccuagccugguacucugauuuuuucccugaggaggaagagagcaacaauuuagcauauauuuguaaguauuguccaugcagaagcuuuucugugcaucauuugaaccccauuaguauccuuuccaguaauggaguguucuguccccuaccucuuagauaguccugugaaggugugggugugaaagaucgugugucuuugaauccuggcuguguggaaacaggcauuuuagcuucuacagccauuuggugugcacccagaccccuugagacugauuguguaacccuuuacaauauauggauuugucucugugacccaaaucaacccaucccuacauuuauauaccuuacagugguuuucuugc

SEQ ID NO: 238 - RNA, 416 nt, Homo sapiens
uuuuuuuuuuuuuuuuuaccguucuuuauuuaaaaaaauaaaauaggaguccguagggugcacccuccccccuccugagugaaggagggcacggugcaguccggaccugggagaggggaaagcccggcaggcaggcgagaccgcuucacacaguggucucgccaugccggcuguuggugagacgaguguagaacuuccuccacgagugcagugucuugccggaccagauccagaagcccgacgugaugcccacgaugagcgucaugagguauuugaucauguagacugugaagucgggcgacaugcggggcguguagugggccgggcaggggauggcuaggcucuugcagugcuggcuuacccaggagcgcucccagugcucgcggaaggccugcucauagaaguagcaggcgaug

SEQ ID NO: 239 - RNA, 2380 nt, Homo sapiens
ggccgcgucgacgccucuccagcugcucuguggcagcccagcuaccggucgugaccagauccagcuugcagcucagcuuuguucauucgaauugggcggcggccagcgcggaacaaacaugcagcggcucggggguauuuugcuguguacacugcuggcggcggcgguccccacugcuccugcuccuuccccgacggucacuuggacuccggcggagccgggcccagcucucaacuacccucaggaggaagcuacgcucaaugagauguuucgagagguggaggagcugauggaagacacucagcacaaacugcgcagugccguggaggagauggaggcggaagaagcagcugcuaaaacguccucugaggugaaccuggcaagcuuaccucccaacuaucacaaugagaccagcacggagaccagggugggaaauaacacaguccaugugcaccaggaaguucacaagauaaccaacaaccagaguggacagguggucuuuucugagacagucauuacaucuguaggggaugaagaaggcaagaggagccaugaauguaucauugaugaagacugugggcccaccagguacugccaguucuccagcuucaaguacaccugccagccaugccgggaccagcagaugcuaugcacccgagacagugagugcuguggagaccagcugugugccuggggucacugcacccaaaaggccaccaaagguggcaaugggaccaucugugacaaccagagggauugccagccuggccuguguugugccuuccaaagaggccugcuguuccccgugugcacaccccugcccguggagggagagcucugccaugaccccaccagccagcugcuggaucucaucaccugggaacuggagccugaaggagcuuuggaccgaugccccugcgccaguggccuccuaugccagccacacagccacagucugguguacaugugcaagccagccuucgugggcagccaugaccacagugaggagagccagcugcccagggaggccccggaugaguacgaagauguuggcuucauaggggaagugcgccaggagcuggaagaccuggagcggagccuagcccaggagauggcauuugaggggccugccccuguggagucacuaggcggagaggaggagauuuaggcccagacccagcugagucacugguagaugugcaauagaaauggcuaauuuauuuucccaggaguguccccaaguguggaauggccgcagcuccuucccaguagcuuuuccucuggcuugacaagguacagugcaguacauuucuuccagccgcccugcuucucuggcuugggaaagacaggcauggcggguaagggcagcggugagucgucccucgcuguugcuagaaacgcugucuuguucuucauggauggaagauuuguuugaagggagaggaugggaaggggugaagucugcucaugauggauuugggggauacagggaggaggaugccugccuugcagacguggacuuggcaaaauguaaccuuugcuuuugucuugcgccgcucccaugggcugaggcaguggcuacacaagagcuaugcugcucuguggccucccacauauucaucccuguguuucagcuccuaccucacugucagcacagcccuucauagccacgcccccucuugcucaccacagccuaggaggggaccagaggggacuucucucagagccccaugcucucucucucaaccccauaccagccucugugccagcgacagcccuuccaaauggagggagugaaauccuuugguuuuauuauuuucuccuucaaggcacgccugccacuaaggucaggcugacuugcaugucccucuaacguucguagcagugugguggacacugucuuccaccgacugcuucaauaccucugaaagccagugcucggagugcaguucguguaaauuaauuugcaggaaguauacuuggcuaauuguagggcuaggauugugaaugaaauuugcaaagucgcuuagcaacaauggaaagccuuucucagucacaccgagaagucacaaccaagccagguuguguagaguacagcugugacauacagacagaagaaggcugggcuggaugucaggccucagaugacgguuucaggugccaggaacuauuaccauucuguaucuauccagaguuauuaaaauugaaaguugcacacauuuguauaagcaugccuuucuccugaguuuuaaauuauauguauacacaaacauguggcccucaaagaucaugcacaaaccacuacucuuugcuaauucuuggacuuuucucuuugauuuucaauaaauacaaauccccuucaugcaaaaaaaaaaaaaaa

SEQ ID NO: 240 - RNA, 2659 nt, Homo sapiens
  misc_feature (1274)..(1274): n is a, c, g, or u
  misc_feature (1358)..(1358): n is a, c, g, or u
  misc_feature (1507)..(1508): n is a, c, g, or u
gcacgagcagcccgcagcccgccgcgccugugcgagccgggacagcacucggccccgcgcgcuccccgccccgcgccagccccgccgcggcgaccugcugcagcggaggaccccaucgaucggagacccggggagcagcgcgcagcccgcgagccgacgggccccgacugcgucuuuguccccggaggcuccgggaaguuugcagcgggacgcgcgcgugaaggcagcgugggcagccccgacgucgccgagcaacaugggcgucgggcgcagcgcgcggggucgcggcggggccgccucgggagugcugcuggcguuggccgccgcucugcuggccgcggguucggccagcgaguacgacuacgugagcuuccaguccgacaucggcucguaucagagcgggcgcuucuacaccaagcccccgcagugcguggacaucccgguggaccugaggcugugccacaacgugggcuacaagaagauggugcugcccaaccugcuggagcacgagaccauggcagaggugaagcagcaggccagcagcugggugccgcugcucaacaagaacugccacaugggcacccaggucuuccucuguucgcucuucgcgcccgucugucuggaccggcccaucuacccgugucgcuggcucugcgaggccgugcgcgacucgugcgagccggucaugcaguucuucggcuucuacuggcccgagaugcucaaaugugacaaguuccccgagggcgacgucugcaucgccaugaccccgcccaauaccacggaagccucuaagccccaagguacaaccguguguccuccaugcgacaacgaguugaagucagaggccaucauugaacaucucugugcaagcgaguuugcacugaggaugaaaaucaaagaagugaagaaggaaaacggugacaagaagauuguccccaagaagaagaaacccuugaagcuggggcccaucaagaagaaggagcugaaggcgcuugugcuguuccugaagaacggugccgacugucccugccaccagcuggacaaccucagccacaacuuucucaucaugggccgcaaggugaagagccaguaccugcugacagccauucacaagugggacaagaaaaacaaggaguucaaaaacuucaugaagagaaugaaaaaccacgagugucccaccuuccagucuguuuuuaagugauacuggggcggacuggggaaggggaguguggcuuggggugagggugggggcgcguggaugacccuggcucuunggggcucacauauugcucucacccauacaguuguggcuuuugcauugcaccuggcucuguuccuacagcgaacccucucccuunccuccauagccacauccagcuaaggccacggccuuuagauuaggaaggcuuuuuuuuuuuuaagggcugcagcagggccagcagcgacgugcaaaaggagaggcagaauccuuucacugagccuggggcacaaaaaacagaaaauguunnccgguuuggaaaaacaaaacaaaacggauuguaaagaacugcagacggacagcugcucagcucaacguuguucgggacaucauuaccaauugcuuguggagucuaagccucuacagguagaagagucugaucauugccaagccaggcugcuuucaguuuauuauuaaucccccucuuucugccuuagauagaccaucgccaccuucaaaacacacacacacacacacacacacacacacacacacacacacacacacacacacacuucugaaaguagccaggguaucccaguauagaacgggauagcuaaggguuugggugggaggccacugcuacucuaccuucagcuuuugaacuggccaccuuugauaggaaacugaggucucagauggacacuucuaccaguccaucgggauacaaggaugccaggcaagggucugcuuuugucugaaggagguacgugggcaugaagagacaugaggcauuucaggcugagaagcaacagcuacuaguuuucaacaauagaguggaagaaaugagcaaagguagaaaugucaagcaggucacaagucagggugauugggggaauccugugccaacagccucacuuuguaauuccaucugucacuuucaaaagaacagcagcauaagacagggauaaaagcccacauacccuccaaggcuugaguaaaaguccacacucagcauuucaaagacuaacgucguugacugcccaaggcugcccucuuaauacaccgccuaugcaugugcuguggaaggcaacucugugcaugugcuguggaggagaugggccucauggcugugcuggcugcccggaaucaguauagcguggaaggagacaguauccauagacucugcuuuucugcaaggaaagcccuuuuccuuauacaugauugccuauaauucagacaaauuuaaaaucgcugccugccugagcccuccaccuuuacuuuugcauucuccggucauauucuuuugaggcuaaagugcccuauccgaggagaugguuucaaaggcuaacuaaucugcagcuuucccaagugcccagagguauuucucaaaguugguaugcuuaauaagugauguaaauauuccaguucucuuaggcagccuuacuccuguugucccug

SEQ ID NO: 241 - RNA, 3347 nt, Homo sapiens
aauuccgaguggccgcgcggcuauuuaaguggcguuacuccgcguccucggcgcugcagccuugaggcuucgggcgcgggggaagucaugcuggcuccacagaagcacuagcuaguccguguacuuuguggguucuguccuuuugagaccugcccgccggggauuggcugguaucagugacugucuacugcuggauuuucugcuugccuucccgucaugucuaacgaaguagaaacaagcacaaccaauggccagccugaccaacaggcugccccgaaagcgccaucaaagaaggagaagaagaaagguucugaaaagacagacgaguacuuguuggccagguucaaaggugaugguguuaaauacaaggccaagcuaaucgguauugaugaugugccugaugcucgaggagacaaaaugagucaggauucuaugaugaaacucaagggaauggcagcagcuggucgcucucagggacaacacaagcaaagaaucugggucaacauuuccuugucuggcauaaaaaucauugaugagaaaacugggguaauugaacaugaacauccaguaaauaagauuuccuucauugcucgugaugugacagacaacagagcauuugguuauguguguggaggugaaggccagcaucaauuuuuugcuauaaaaacagggcaacaggcugagccauuagucgucgaucuuaaagaccuuuuucaaguuaucuauaauguaaagaaaaaggaagaagauaagaaaaagguugaagaagccaacaaagcagaagagaauggaagugaggcccuaaugacccuugaugaucaagcuaacaaauugaagcuggguguugaccagauggauuuguuuggggacaugucuacaccuccugaccuaaauaguccaacagaaagcaaagauauccuguuaguggaucuaaacucugaaaucgacaccaaucagaacucuuuaagagaaaauccauucuuaacaaauggagucaccuccuguucucucccucgaccaaagccucaggcauccuucuugccugagaacgccuuuucugccaaucucaacuucuuucccaccccuaacccugauccuuuccgugaugaucccuuugcacagccagaccaaucggcacccucuucguucgauucucucacaucuccagaucagaagaaagcgagucugaguagcucgucuacuccacagaguaaagggccccugaacgucgauacugauuacuuuggucagcaauuugaccagcucucuaaccggacuggcaaaccggaagcucagggaggcccguggcccuacccaaguucgcagacccagcaagcagugagaacucaaaaugggguaucugaaagagaacagaacggcuuccauaucaaaucuuccccgaacccuuuugugggaagcccucccaaaggacuaucgguaccgaauggcguaaagcaggacuuggaaaguucuguccaguccucagcacaugacuccauagccauuaucccaccuccacaaaguaccaaaccaggaagaggcagaaggacugcuaagucuucagcaaacgacuugccugcuucagacaucuuugccucagaaccuccaggccagaugucccccacaggacaaccugcagucccgcagucgaacuuccuggaucucuucaaaggcaaugcuccucccccaguggggccccuuguaggucuagguacggucccaguaacacccccccaagcaggacccuggacgccuguugucuacaguccuucgacaacuguggucccaggagccauaauaaguggccagccucccaguuuucgccagccacucguuuuugguacaaccccagcaguacaagucuggaaucagucuccaucauuugcaaccccagcuuccccuccaccccccacaguuugguguccuaccacaucuguggcgcccaacgcuuggucauccacaagcccucuggggaauccuuuucagaguaauaauaucuuuccaccucccaccauguccacucaguccucuccucagccuaugauguccucuguucuggccacaccgccucaaccaccuccccgaaauggcccacuaaaggacauucccagugacgcuuucacuggcuuagacccccuuggggauaaagaggucaaggaagugaaagaaauguuuaaggacuuccagcugcggcagccaccucuuguucccucaaggaagggggagacgccucccucugggacuucaagcgccuucuccaguuacuucaacaauaaaguuggcauuccucaggagcauguagaccaugaugauuuugaugccaaucaacuguugaacaagauuaaugaaccaccaaagccagccccgagacaagguguccucuuggguaccaagucugcugacaauucacucgagaacccuuucuccaaaggguucagcucaucaaaccccucugugguuucucagccugcaucuucugauccccacaggagcccuuucggaaauccuuuugccuagcuucugaaguuguaaugaugacuauccagaugagcaaaagacuggcuuuggucaagaaugaagcagacagccagaaacauguugaccucuguccucgcuccagcuuugacguauuaucuguuacccuauuuguuuuggccucuuguacuuguaaaaugccuuucauuuuccugucuaggcuaaagcuaaacuuaaacuauggcuuuacguaaauuaagcuccuaaacucucuagcuccaauauaaaugaaguagcuucccuaucaaaucccugucuguugugcccccuugaaacuuccagaauauucuccauucuacccuccauuugggaggagcggcuaccuuuacccuuaauaucacacugccuugagucaauguccaaauacucauagcucucaaagucauuugggguuccuggugugcggccuaaaccuaaagcauccuauuaauagggaaguaagacaccuugcuuccuauguccacucagggagaauuuuauuuaauaaaaugaaagcaagacuaacuucucaaauccacccaaggaccauuuugagauggucguuucucagcuaacugcaccauuuaccaauccugccccaaguggugcuuacauuugacuugaagaagagaaagagcuaacucaaaacacaaggcauuauucaaagcuaauaaaacaauuucucccuggggccccacauuguuuucauuccagauacguugcagcuguuugacccugaugacauuaugcccuacauuuuccuugaagauccugauuuuauuucaugugauuuuuguuucucaauaaagaugauuauugugugcacggaauuc

SEQ ID NO: 242 - RNA, 555 nt, Homo sapiens
augaaucgcaccgcauacacugugggagcguugcuucuccuccuggggacccuacugccaacagcugaggggaaaaagaaagguucccaaggagccauuccgccuccugacaaggcucagcacaaugacucugagcagacccaguccccaccacaaccuggcuccaggacccgggggcggggccaggggcggggcaccgccaugccuggagaggaggugcuugaguccagccaagaggcccugcacgugacagagcgcaaguaucugaagcgagauuggugcaaaacucagccccugaagcagaccauccacgaggagggcugcaacagccgcacuaucaucaaccgcuucuguuauggccagugcaacuccuucuacauccccaggcacauccgaaaggaggaaggguccuuucagucuugcuccuucugcaagcccaagaaguucaccaccaugauggucacacucaacuguccugagcuacagccacccaccaagaagaaaagggucacacgcgugaagcagugccguugcauauccaucgacuuggauuaa

SEQ ID NO: 243 - RNA, 2526 nt, Homo sapiens
guggaauauccauggagguacggagccuuguuaccaaccuuuaaccgcagaacugggauguggggcuggaagugccuccucuucugggcugugcuggucacagccacucucugcacugccaggccagccccaaccuugcccgaacaagcucagcccuggggagucccuguggaaguggagucucuccugguccacccuggcgaccugcuacagcuucgcugucggcuucgcgaugaugugcagagcaucaacuggcugcgggauggggugcagcugguggagagcaaccguacccgcaucacaggggaggagguggaggugcgggacuccauccccgcugacucuggccucuacgcuugcgugaccagcagccccucuggcagcgauaccaccuacuucuccgucaaugucucagaugcacucccauccucggaagaugaugacgacgacgaugacuccuccucggaggagaaagagacggacaacaccaaaccaaaccguaggccuguagcucccuacuggacauccccagagaaaauggagaagaaacugcaugcggugcccgcugccaagacggugaaguucaagugcccgucgagugggacacccaaccccacucugcgcugguugaaaaauggcaaagaguuuaagccugaccaccgaauuggaggcuacaagguucgcuaugccaccuggagcaucauaauggauucuguggugccuucugacaagggcaacuacaccugcaucguggagaaugaguaugggagcaucaaccacaccuaccagcuugacgucguggaacgaucuccgcaccgacccauccuucaggcagggcugccugccaacgagacaguggcccugggcagcaauguggaguucauguguaagguguacagcgauccgcagccucacauucaguggcugaagcacaucgaggugaacgggaguaagaucgggccagacaacuugccguauguccagauccugaagacugcuggaguuaauaccaccgacaaggaaauggaggugcuucaucuacggaaugucuccuuugaggaugcgggggaguauacgugcuuggcggguaacucuaucggacucucccaucacucugcaugguugaccguucuggaagcccuggaagagagaccagcugugaugaccucaccgcucuaccuggagaucauuaucuacugcaccggggccuuccugaucuccugcauguugggcucugucaucaucuauaagaugaagagcggcaccaagaagagcgacuuccauagccagauggcugugcacaagcuggccaagagcaucccucugcgcagacagguaacagugucagcugacuccagugcauccaugaacucugggguucuccugguucggcccucacggcucuccuccagcgggacccccaugccggcuggagucuccgaauaugagcucccugaggauccccgcugggagcugccacgagacagacuggucuuaggcaaaccacuuggcgagggcugcuucgggcaggugguguuggcugaggccaucgggcuggauaaggacaaacccaaccgugugaccaaaguggccgugaagauguugaaguccgacgcaacggagaaggaccugucggaucugaucucggagauggagaugaugaaaaugauugggaagcacaagaauaucaucaaccuucugggagcgugcacacaggaugguccucuuuaugucauuguggaguacgccuccaaaggcaaccuccgggaguaucuacaggcccggaggccuccugggcuggaguacugcuauaaccccagccacaaccccgaggaacagcugucuuccaaagaucugguauccugugccuaucagguggcucggggcauggaguaucuugccucuaagaaguguauacaccgagaccuggcugcuaggaacguccuggugaccgaggauaacguaaugaagaucgcagacuuuggcuuagcucgagacauucaucauaucgacuacuacaagaaaaccaccaacggccggcugccugugaaguggauggccccugaggcguuguuugaccggaucuacacacaccagagcgauguguggucuuuuggagugcucuugugggagaucuucacucuggguggcuccccauaccccggugugccuguggaggaacuuuucaagcugcugaaggagggucaucgaauggacaagcccaguaacuguaccaaugagcuguacaugaugaugcgggacugcuggcaugcagugcccucucagagaccuacguucaagcaguugguggaagaccuggaccgcauuguggccuugaccuccagccaggaguaucuggaccuguccauaccgcuggaccaguacucacccagcuuucccgacacacggagcuccaccugcuccucaggggaggacucugucuucucucaugagccguuaccugaggagcccugucugccucgacaccccacccagcuugccaacaguggacucaaacggcgcuga

SEQ ID NO: 244 - RNA, 468 nt, Homo sapiens
auggcugaaggggagaucacaaccuucgcagcccugaccgagagguucaaccugccucuaggaaacuacaaaaagcccaaacugcucuacugcagcaacgggggccacuucuugaggauccuuccugauggcaccguggaugggacaagggacaggagcgaccagcacauucagcugcagcucagugcggaaagugcgggcgaaguguauauaaaggguacggagaccggccaguacuuggccauggacaccgaagggcuuuuauacggcucgcagacaccaaaugaggaaugucuguuccuggaaaggcuggaagaaaaccauuauaacacuuacaccuccaagaagcaugcggagaagaacugguuugugggccucaagaagaacgggagcuguaagcgcgguccucggacucacuauggccagaaagccaucuuguuucugccccucccggugucuucugacuag

SEQ ID NO: 245 - RNA, 3115 nt, Homo sapiens
auggacaccuccugcguccacaugcuccuguccuugcuggcgcugcugcaguugguggccgccggcagcucaccgggaccagaugcgauaccgcggggcugcccaucacacugucacugugagcuggauggcaggaugcugcucaggguggacugcucggaccuggggcucucggagcugcccuccaaccucagcgucuucaccuccuaccuggaccucaguaugaacaacaucagucagcuacccgccagucuccuacaucgccucugcuuccuagaagaguuacgucuugcuggaaaugcuuugacacacauucccaagggagcguucacgggccuucacagccucaaagugcuuaugcugcagaacaaccagcugagaaagguuccggaggaagcgcuacagaauuugagaagccuucaaucccugcgccuagaugccaaccacaucagcuacgugccacccagcuguuucagcggccugcacucccugaggcaccuguggcuagaugacaaugcucucacagacgucccuguccaggcuuucagaaguuuaucagcccugcaagccaugaccuuggcccugaacaaaauacaccacauagcagacuacgccuuuggaaaccucuccagccucgugguucugcaucuccauaauaauagaauccacucccugggaaagaaaugcuuugauggacuccacagccuggagacuuuagauuuaaauuauaauaaccuugaugaauuccccacugcaaucaagacacucuccaaccuuaaggaacuaggauuccacagcaacaacaucaggucaauaccggagcgagcguucguaggcaacccuucucuuaucacaauacacuucuaugacaaccccauccaauuuguuggaguaucugcuuuucagcauuugccugaacuaagaacacugacuuugaauggugccucgcacauuacugaauuuccucacuugacaggaacugccacccuggagagucugacuuuaacuggagcaaagaucucaucucuuccccaggccgucugugaucaguuaccuaaucuccaagugcuagauuugucuuacaaccuacucgaagacuuacccaguuugucaggcugccaaaaacuucagaaaauugaccugaggcauaacgagaucuaugaaauuaagggcagcacuuuucagcaguuguuuaaccuccgaucucugaacuuagcauggaauaaaauugcuaucauucaccccaaugcguuuucuacguugccgucucuaauaaaguuggaccuaucauccaaucuccugucguccuucccugugacuggguuacaugguuuaacucacuuaaaauuaacagggaaccgagccuuacagagccugauaccaucugcaaacuucccagagcucaagauuauagaaaugccaucugcuuaccaguguugugcauuuggggggugugagaaugucuauaaaauuucuaaccaauggaauaaagacgacggcaacaguguggacgaccuucauaagaaagacgcuggguuauuucaaguucaagaugagcgggaccuugaagauuuccuacuugacuuugaggaagaccugaaugcccuucacucggugcagugcucgccuuccccaggucccuucaagcccugugagcaccuauuugguagcuggcugauccgaaucgggguguggaccacggcaguacugacgcuuuccugcaaugccuugguggcuuugaccguguucagaacuccccuguacaucucuuccauaaagcugcuaauugggguaaucgcgguaguggacauucucaugggggucuccagugcugugcuggcugccguggaugcauucacuuuuggccguuuugcucagcacggugcguggugggaagacggaaucggcugccaaaucguuggcuuccuguccauuuuugcuuccgaaucgucgaucuuccugcucacucuggcagcgcuggaacgagguuuuucugucaagugcucuucgaaguuugaagugaaagcuccccuuuuuagccugagagcgaucguuuugcuauguguccuguuggcccugaccauugccacaauccccuugcuaggaggcaguaaguacaaugccucuccccucugccugcccuugcccuuuggggagcccagcaccacgggcuacaugguggcucucguguugcucaacucucucuguuuccucauaaugaccauugccuacacaaagcucuacugcaguuuggagaaaggagagcuggagaaucuuugggauuguucgauggugaagcacauugcucuguugcucuucgccaacugcauccuuuacugccccguggcuuucuuauccuucuccucuuugcuaaaccucaccuuuaucaguccugacgucauuaaauuuauacuucucgugaucgucccacuuccuuccugucucaacccacuucucuacauugucuucaauccccauuuuaaggaggauaugggcagccugggaaagcauacccguuucuggaugagaucaaaacacgcgagucugcuguccauuaacucggacgauguugagaaacgguccugugagucaacccaagccuuaguauccuuuacccacgccagcauagccuaugacuugccuuccacuuccggggcaucaccagcuuaccccaugacugaaagcugucaucucucuucaguugcauuugucccaugucucuagugacuaugagagaggaacguuuuuaagaguuggaaaccugaaaagugauuucuaucagagcaguagcuaagaaaagcugagcuaaaaaccuaccuuaaaacccaagcaaacaucucuaaauugguguggaaacaguggugccuuagagcaggagagcaucauuaaacaccgcuuguaucauuuguucagcuaagaaggaaagccaucaagucacuuaggugaacccagaugagaaaagcagccugaaaugcucuucgcauuguagucucuucugacucaccagcauagucucccauagugagaagacucguuggaugacucaauggguguauuuaaauccacaaauuccuuguuuaaaagguuagaguuuuaagaaaaaaaaaaaaaaaaa

SEQ ID NO: 246 - RNA, 5561 nt, Homo sapiens
  misc_feature (4879)..(4879): n is a, c, g, or u
  misc_feature (5116)..(5116): n is a, c, g, or u
uuuuuuuucuucaccuccucccuuuucaaggccuccaagcuaauuauuucuguugcuuuggagugagcaauucugugguucucuccaccaccacccccaauucugacccgaucccgccuggggguuucuacggucuccgcucacucugcgugcaccuggcgcgccucuuuuuuucacccccaaccuguugcaagucuuuaauccucgcaauugggacuugcgugcaggcaccugaauccuccuugccucauauuuugcaaguguuugggggagagcaccugcucuaccugcaagagauuuaaaaggaaaaaaaucuccaggcucccucuuucuccacacacucucgcucuccugccccgccccgagguaaagccagacuccgagaaaauggugaucagcgugguccuccugcugcuggccgccuaugccguaccggcucaaggccuggguucuuucgugcauugugaacccugcgacgagaaagcucuguccauguguccccccagcccucugggcugugagcuggucaaagagcccggcuguggcugcugcaugacuugcgcccuggcggagggacagucguguggugucuacacagagcgcugcgcccaggguuugcgcugccucccccggcaggaugaggagaagccgcugcacgcccugcugcacggccgcgggguuugccucaacgaaaagagcuacggcgagcaaaccaagauagagagagacucucgggaacacgaggaacccaccaccuccgagauggcugaagagaccuacucccccaaggucuuccggcccaagcacacucgcauuuccgagcugaaggcugaggcugugaagaaggaccgcagaaagaagcugacccaguccaaguuuguggggggugcagagaacacugcccaccccagagucaucccugcaccugagaugagacaggaauccgaacaaggccccugccgcagacacauggaagcuucccuccaggaguucaaagccagcccacgcauggugccccgugcuguguaccugcccaacugugaccgcaaaggauucuacaagagaaagcaguguaagcccucccguggccgcaaacguggcaucugcugguguguggacaaguacggaaugaagcugccgggcauggaguacguggauggggacuuucagugccacgccuucgacagcaguaacguugagugacgcguccccucccuuccucccccuauccuacccccccagccccaacuccagccagcgccucccuccaccccaggacgucacucauuucaucucauuuaggggaaauauauauacauauauauuugaggaaacugaggaccucggaaucucuagcaagggcuaaggagacacuccccaccaugaccccggaaauguauuccuuuuugaagcaaguugaacggacagagaagggaaggagagaagaagcaagagggagcgagagauggaaagaaagcaaagcguuggaauagaggaaaagagggaaggacagauaggauuagagagagaagagagaaacagcaaggcagaaaggacuccacaaccaaggcugaaucugcccuuuugcuuucagcucuagccuggggucagaaaaaguguggcauucagugacacccaguuuagauuggucaaggggagaaaagaaacaaggugugucagugccucucgggucuguccccuccugcagccagcaguguggauggcuagaccccucacccuccucuccucuuacccaagugcagggugauuucauccccaaauuuacaaagacuaaaaugcauuccaucccucugaaaauaaacaaaagugagugauugaagauagguuuucccccagcagacaagugaacucagaaugugugcaaauuuuacucuuguuaaagauuuuuuuaagaagucaguacgcacccccaacacuggaaagacuugauucuccagggugacaagcaauucagaagcgcguggcuucggcccuugauuucacuagacucaaagcuggcccggcagccucuguggaggaggaugagagguggagaaaaccaaggggcuuguacucacccacaagacuccauguagacuuuauaggcauauaaaucuauuuucuuuaccuuuuuuucccuuucccuuucuuucgaaguuuugcauuaccucuuuaaaguaguuuuuuuuaggacacugaagaucuuccucauucugggaaaaauccauauuucacaaauacaacccagaacgccagcuuggccugcguccaggcagccuuucucgugagcuacaaguguggcucuuuuguggggcaccgauuuggaucuucucaugauuccaaacguguguugaagugaauccaccaagccagguaacugccagcacccaagggugcaucaagugcauagcccaggucaccccauuucagccuuccaacccgcagaaaguaacugucucacaccacaccacauaaaccugccagauccaucuguaacccacuggccugcccagaccuuuuuuucccaucugcauuuuuuuuuuugaacugcauuuugaaagccucccucagaugccaggcugacagaucagagagaaacuaacaugagagaugacagaggaggaggaaguggagggugggggcagagacuuccacagagagacauagaagauggagcagaggucuggggguggggaggacaagaaagagacagagagaggaaaauaccaauagaauuuuccuuggugucucccaucuaaucaacucucugagauuugagaggaaaaagaaggcaggggaagaacuugagguagaaaugaggucaguucaagucacagggcccagaugguggguaacugaggcaggauccagacuugagacacacgguuggaaacaaggcugguuagccugacuggguauugaagggugaagaggaugccuuggaaagacagcacaacuucaguucaacuucaggcccccaaggaggaacugaggccaaagaauccuucaagugcuucaugagucuccucugcccgacucaaacauccuucccugugauggaggaugguagaaagcccaggacaacucaggcccggaucuucacgacuguugucauuugccagccugauuuugauccaagagaagcaucucauugcccacuggcuucuucaacaaagaggugcuuaacaaaaggcucaggacuaucuuugaagacugaagauaaccuuccaggagaggagacucggacauugguacaggaggccccuuuuggcgggggacacagcucuuugcgcucucuugauggcauggcauaguagaggcccccuccaacccggaacauggagcaacacaaagggagagcaaagaaacugacgugcgucgacucauaggacauggguggcugcgggcacagaaagggaugccuccuguugccuggacaggacaguuggcugggaaggaaagagaaaauugaucuucauaagacaaagggccugaugggauggcaauagaaggacuuaccagaccugcagggucaguauacccaucaccccgcacaacauccccagcccccaacucaaacuucaauauaucuuaggccaguauccuagaccuaagucucuccuuucugccauuauuucuccgcaucuugagcagucaucugacugagauuugccaaguggauacugggguaccacugccccccaagaaaagacugagccaggaacugccuacucgcucccccucccgagccuggagcuaacuccugugaggggugcucucuucaccccacaacuuacuagaccuugagugagccucugucccuuaugugggcucuucgcugugagccacagauggaggucauuguauagacaguuagccuuccccaggucagccuaccucccccaaacuugugagucuccccgcugcucauauggagaggcaugucuaagacagcaagucuucuagaggaagcuugccuuuaacagacagauggaacuaaaccuuccaaaugggagaucuggcugaacccaggauacagagaccauggacauggauggggucaucaagagaagagggauguccuucuccagguuagggagagagaaggcaaguuugcaacgaucccaucaugcccugagcaagaagcuuuuggcccaggcuagccuuuaacuccauuagaggccucucuguuggguuuauccacagcaguaggcccaaguauggccuguccccaccucuacuaucccguggaagguuucuucccaccccuuuuugacaaaugccucacucgagcaguggaaagauagcucucuucccccucuucugccagguaacaaagagaccuaaccaggaccuauucuccaccccagccagucuugaccagccagaacaaagcagggaaccuggagaauaaaagacucuacguuccucugacaaagacucuacguuucucugacggccaggccuaaacagacaaggcuugggaacaucugccccacaggauacggaggaggucagcugugcucacuccucuucuccuuccaagacccucuuccgaccaugacuuaucuccaugguaacauccucaccaucauucucccacuaccaaggguugccauggcaaccucccaaccaccugcccaucccaggcaggcagcuguccuucugcucagaacccuagaggacucuaggugaaauuuuacagcuuaagagaggagugagccaaggagaagagacccuguaguccucuggcuuucaagagaaagaaggcuaugauuuaaaacacaguagaagggaaagaggucucgucgaggucgaccucucccggggagcuuagggguuguacugucuuuauuuuuuaaaccacuaaagugcaaunuuuccugcacucuuguuaccccgccucucuucccuguuagguuuucauuuccuugagcagacuuucuugguuuuuuaauggaguauagacuuucaccacuucacagacucuggccuccucuccaagucucucuggauggggaaaaggaagguagagggucagaggggaaggggucccucgucaccccgcauccauucacccccacuucucuggucccuagucaccggcuucaccccnaucuccgacaccaucacugucacacaguagccugucacacggauaguacaguucagacaagacuccuucagauuccgagacgccuaccgguuguuuuugguuuuuguuuuguuuucuuuuguuuguuuguuuguuuguuuuuuacaacagcaauaaccacaucacauauuacuguagcucucuauaguguuacguucagacaccguagcucuguccucucuuauuuuguugguuuugacuuaaaaaaaaauacuuaugcuuuuuacuggugaaacagauugaaaaaaaaauugaacaacaaaccaguuugugaaaaaaaaaaaaaaugugaaaaaaaaucaccccgauguggaagagcucggcuccucuuuagcauuuuguacuuaaggaaauaaaaaagaaaaaccuggaagaucucacauuuuauuacaaagugaaaaaaaaa

SEQ ID NO: 247 - RNA, 1113 nt, Homo sapiens
guccagucugcagucuguauucggaagacauagauacuaaauacauggcaacucuuuuuuuuguuuguuuuaauucaucaggauguggagcgcuagucuggguaggagagccagucacccugaggacagcugaaacaaucgcuggcaaguauggaguguggaugagagaccccaagcccacccaccccuacacccaggaaagcacauggaggauugacacgguuggcacagagauccgccagguguuugaguacagucagauaagccaguucgagcagggcuauccuuccaagguccaugugcucccucgggcacuggagagcacgggugcugugguguaugcggggagccucuauuuccagggggcugaguccagaacuguggucagguaugagcuagacacggagaccgugaaggcagagaaggaaauuccuggagcuggcuaccacggacacuucccguacgcgugggguggcuacacagacauugacuuagcuguggaugagagcggccucugggucaucuacagcacggaggaagccaagggggccauaguccucuccaaauugaacccagcgaaccuggaacuugagcguaccugggagacuaacauccguaagcagucuguggccaaugccuuuguuaucuguggcaucuuguacacggugagcagcuacucuucagcccaugcaaccgucaacuucgccuacgacacuaaaacggggaccaguaagacccugaccaucccauucacgaaucgcuacaaguacagcaguaugauugacuacaacccccuggagaggaagcuguuugccugggacaacuucaacauggucaccuaugauaucaagcucuuggagaugugaggagccucuaugccuaccagcaaaggccagaaaaggugaaguuccgggcucccgggugaagcagcugucagcagaggcagccagaugcauggaguuucuccuccugcuaaagauuuuguuuauccgggucaauguacagcuagcuccccucugacugacacguccuccaggcuuguauagucgcauagacucuguucucuucugucagcuuucaaagggcuguuccucuuuuaaaaaucacauagug

SEQ ID NO: 248 - RNA, 1635 nt, Homo sapiens
gggagaccugagcucgcugcugccuguggaagacugggagaggagacacuaagugcugcucaagcaagcgcgauccucuccucuuucaaccugcagcccaagauacugauucgagccgcgccuuaccgcgcagcccgaagauucaccauggugaagaucgccuucaacaccccuacggcggugcaaaaggaggaggcgcggcaagauauagaggcgcucgucagucgcacuguccgagcucaaauccugacuggcaaggagcucagaguugucccgcaggagaaagauggcucaucugggagaugcaugcuuacucuccuaggccucucauucaucuuggcaggacugauuguugguggagccugcauuuacaaguacuucaugcccaagagcaccauuuaccauggugagaugugcuucuuugauucugaggauccugucaauuccauuccuggaggagagccauacuuucugccugugacugaggaggcugauauccgugaggaugacaacauugccaucauugaugugccugugcccaguuucucugauagcgauccggcggcaauuauucacgacuuugagaagggaaugacugcuuaccuggacuugcuuuugggaaacuguuaucugaugccccucaauacuuccauuguuaugacuccaaagaaucugguggaacuuuuuggaaaacuggcaaguggcaaguauuugccucauacuuaugugguucgugaagaccugguugcuguggaagaaauucgugauguuaguaaccuugguauuuuuauuuaccaacuuugcaacaaccgaaaauccuuccgccuuagacgcagagaccuucugcuggguuucaacaagcgugccauugacaaaugcuggaagauuagacacuuccccaaugaauuuaucguugaaaccaagaucugucaggagugaaaugugacagauaaagaguauccuugauaauaagaagucaggaacuuaccgucugacuuggaaaauugaaauugaugggauacucaugcuauuuacucauacauuuacucuauugcuuauacuggaaaaggaaagggaaaggggggagaaaacuacuaaccacugcaagcgauuguccaauucuacuuuaauugacauugcuugcuguuuucaacaagucaaaugauuaucuuuucucuugaauuuauaggguuuagauuucugaaagcagcaugaaugugucaucuuaccauccugacaauaaagcccauccucugguuuuauuuaaagcaagcucuuuccaacaucacuuggcuagagcaugcuuuaaauuuaaaauauuugaaauuuguuuuugacauuuuuuugugugaaacaugucaaaucucuuaccauucuuugguuuucuucuuuauuauguucaacucuccugauuucagaaguuacauuuuugcauuucuaucaggugcuguguaacgaaucugacugauaugugaacaaucuucaugaggaagcaauuuuuuacucauguaaugauucuuucucacugauaucuguauugugaaauccacagaacuguacaggugcugaaugcuguaaggaguucugguuguaugaauucuacaacccuauaauaaaguuuaccguauucaauca

SEQ ID NO: 249 - RNA, 3550 nt, Homo sapiens
ggccauuaccaaucgcgacccgcgcacacacggcccgggcggcgggcgaagcgggcucccggggcgcugggcgcagggcgcggggcaagccccagcagcgugucugcaacggggcgcggcgggcgcuccagcuccgggaucuuucucccucggucaccucccucgcgucuagggaggucguggcacucccugaggagcgcggcugcucggagggcggauccuagaacagaggcgugagagccggcaugaauggucauaugucuaaccgcuccaguggguauggagucuacccuucucaacugaaugguuacggaucuucaccacccuauucccagauggacagagaacacagcucaagaacaagugcaaaggcccuuuaugaacaaaggaagaacuaugcccgagacagugucagcagugugucggacgugucccaguaccgcguggaacacuugaccaccuucgugcuggaucggaaagaugcaaugaucacugucgaggacggaauaagaaagcugaaguugcuggaugccaagggcaaaguguggacucaagauaugauucuccaaguggaugaccgagcugugagccugauugacuuagagucaaagaaugaauuggagaauuuuccucuaaacacaaucucgcauugucaagcaguggugcaugcaugcagcuaugacuccauucucgccuugguaugcaaagagccaacgcagagcaagccagaccuucaccuuuuccagugugaugagguuaaggcaaaccuaauuagugaagauaucgaaagugcaaucagugacaguaaaggugggaaacagaagaggcggccggaggcccugaggaugauugccaaagcagauccuggcaucccuccuccucccagagcuccugccccugugccaccggggacugucacacagguggacguuaggagucgcguagcagccuggucugccugggcagcugaccagggugacuucgagaagccccggcaguaccacgagcaagaagagacgcccgagaugauggcagcccggaucgacagggaugugcaaaucuuaaaccauauuuuggaugacauugaauuuuuuaucaccaaacuccaaaaagccgccgaagcguuuucugagcuuucuaaaaggaagaaaaguaagaaaaguaaaaggaaaggaccuggagagggcguuuuaacacugagggcaaaaccgccaccuccugacgaguuuguugacuguuuccagaaguuuaaacauggauucaaccuucuggccaaguugaagucccauauccagaacccgagugcuucagaucugguucauuuuuuguuuacuccacuaaauauggugguccaggcaacagguggcccugaacuggccaguucgguacucagcccacuguugacaaaagacacaguugauuucuuaaacuacacagccacugcggaggaacggaagcuguggaugucacugggagauaguugggugaaagugagagcagaguggccgaaagaacaguucaucccaccuuacgucccgagguuccgcaacggcugggagcccccgaugcugaacuucaugggcgcgcccacagagcaagacauguaucaacuggccgaguccguggccaacgcagaacaccagcgcaaacaggacagcaagaggcuguccacagagcauuccaauguguccgacuauccuccagccgacggauaugcguacaguagcagcauguaccacagaggaccacaugcagaccacggggaggcugccaugccuuucaagucaacuccuaaucaccaaguagauaggaauuaugacgcagucaaaacacaacccaagaaauacgccaaauccaaguacgacuuuguggcgaggaacagcagcgagcucucgguuaugaaagaugaugucuuagagauacucgacgaucgaaggcagugguggaaaguccggaaugccaguggagacucuggguuugugccaaauaacauucuggauaucaugagaacuccagaaucuggaguggggcgcgcugaccccccauacacacauaccauacagaaacaaaggacggaauacggccugagaucagcugacacuccuucugccccaucacccccuccaacgccagcacccguuccggucccccuuccaccuucuguaccagcacccguuucugugcccaagguuccagcagaugucacccgccagaacagcagcuccagugacagugggggcagcauugugcgggacagccagagauacaaacaacucccaguggaccgaaggaagucccagauggaagagguucaggaugagcucuuccagaggcugaccaucgggcgcagugcugcgcagaggaaguuccacgugccacggcagaacguuccagugaucaauaucacuuaugacuccucaccggaagaaguaaagacuuggcugcagucaaagggauucaaucccgugacugucaauagccucgggguguugaacggagcacaacucuuuucucucaacaaagacgaacugaggucugucugcccggaaggugccagagucuuuaaccaaaucacuguucagaaagcugcuuuggaggacaguaauggaagcuccgaguuacaagagaucaugcggagacggcaggagaagaucagcgccgcugcgagcgacucgggaguggagucuuuugaugaagggagcagccacugaguccaugaacuuccuuauucuugguguggucguugaacagugauggacaugcuuuguuuuaagaagccuugaagggaaugucaaagcugucgucuugguauauguaauuuaucgccauauaaggaaacaguauaugccugaguaagcagaggacccgcugcuucugugcacauuaguuugauuaaaacugagaagcggguaggugagauggcucagcaaguaaaggugcuugcugccaagcccaaugacccaaguucgagucccugggucuacaugguaggagagagcuggcuucugcaaguuguccucugaccaccacacauaaauaaauaacaaauguaauuuacaaacuuuuaaaagaaaauguaauuuaaaaaaccagacguucuagacuguucugggcuugggaaauauuuuuuucacuuuccuaagguguacuuuccuuugcuacauuaauuauugcagccuuguucgaugaucuaaguggggauauuugacaauggcagauuuauucauugcaacaaggaaagacacagccauugaugaaaaaaaaaagaaagucucagcuuucagugacugggauaccugcuguccagggaggaggcucaguuagacuacccucugcuuacuugaggucugacaugcccaaugagaguguauuuagcuuuauuuaaaguucuuaaugccaacaguuuuaaaaaucacauuuaaaugaacuguacaagguagccagaccuugaauguaugaauagacuauauaauaugucccgagaaacuuuguuacucucagcucuguugauugcgaaaucuugcauagauuaugcuuugauuuaguuucu

SEQ ID NO: 250 - RNA, 2299 nt, Homo sapiens
ccugggccccgccgcggacgcgcggagccgccugggccgcgccggaggagggcggggagaggaccaugugaaugugcuccggagcugagcgccaagccaagcaguguuugaaaggaacaggaugcugaucuaaucguggcaaaaagucaguccgaccgcugguuucgaagacaugugguguauauaaaguuugugauaguugguggaaauuugggagcuuggauaaugggcugugugcaauguaaggauaaagaagcagcgaaacugacagaggagagggacggcagccugaaccagagcucuggguaccgcuauggcacagaccccaccccucagcacuaccccagcuucggcgugaccuccaucccgaacuacaacaacuuccacgcagcugggggccagggacucaccgucuuugggggugugaacuccuccucucacacugggacccuacgcacgagaggagggacaggagugacacuguuuguggcgcuuuaugacuaugaagcacggacggaagaugaccugaguuuucacaaaggagaaaaauuucaaauauugaacagcucggaaggagauuggugggaagcccgcuccuugacaaccggggaaacugguuacauucccagcaauuacguggcuccaguugacuccauccaggcagaagagugguacuuuggaaaacuuggccgcaaagaugcugagagacagcuccuguccuuuggaaacccaagagguaccuuucuuauccgcgagagccaaaccaccaaaggugccuacucacuuuccauccgugauugggaugauaugaaaggggaccacgucaaacauuauaaaauccgcaagcuugacaaugguggauacuauaucacaacgcgggcccaguuugaaacacuucagcaacugguacagcauuacucagagaaagcugaugguuuguguuuuaacuuaacugugguuucaucaaguuguaccccacaaacuucuggauuggcuaaagaugcuugggaaguugcacgugacucguuguuucuggagaagaagcuggggcagggguguuucgcugaaguguggcuugguaccuggaauggaaauacaaaaguagccauaaagacccuuaagccaggcaccaugucuccggaguccuuccuggaggaggcgcagaucaugaagaagcugaagcaugacaagcuggugcagcucuacgcggucgugucugaggagcccauuuacaucgucacggaguacaugagcaaaggaaguuugcuugacuucuuaaaagauggugaaggaagagcucugaaguugccaaaccuuguggacauggcggcacagguugcugcaggaauggcuuacaucgagcgcaugaauuauauccacagagaucugcgaucagcaaacauucuaguggggaauggacuaauuugcaagauugcugacuuuggauuggcucgguugauugaagacaaugaauacacagcaagacaaggugcgaaguuucccauuaaguggacagcccccgaagcggcccuguauggaagguucacaaucaagucugacguauggucuuuuggaaucuuacucacagagcuggucaccaaaggaagagugccauacccaggcaugaacaaccgggaggugcuggagcagguggagagaggcuauaggaugcccugcccacaggacugcccgaucucccugcacgagcucaugauccacugcuggaaaaaggauccggaagagcgcccgaccuucgaguacuugcagggcuuccuggaggacuacuuuacggccacagagccccaguaucagcccggugaaaaccugugagagccugcgcuucagacgccucuucccgaggccucccuaccccuccccauuagcuuccaauucuguagccagcugccccagagcaggagaaccguccaggaucagauugcaugugacucuugaagcugaacuuccacggcccucauuaaugacacuugucccccaguccgaaccuccucugugaaccaucugagacagaagcguguuauuucucagacuuggaaaugcauuguaucgauguuaugucaaaggccaaaccucuguucaguguaaauagcugcuccugugccaacaaucccagugcuuuccuuuuuuaaaaaagaaaaagcaaauccuaugugauuuuaacucugauuucaccugauucaacuaaaaaaaaaaaaguauuauuuuccaaaaguggccucuuugucuaaaacaauaaaauuuuuuuucauguuuuaacaaaaaaaaaaaaaaaaaaaaaaaa

SEQ ID NO: 251 - RNA, 3991 nt, Homo sapiens
cccucccuggcucucuccucagcucugggcucugacugcagcaagcagagacaaccucucacucugccuuucccagcgcccacccugacccuggcccacauuugacggugacucgcaggccagccagaaacaugaggcuggcccacgcucugcugccccugcugcuacaagccugcuggguggccacacaggacauccagggcuccaaagcgauugccuuccaagacugcccuguggaucuauucuucgugcucgacaccucggagaguguggccuugaggcugaaaccuuauggggccuugguggacaaggugaaguccuucacuaagcgcuucauugacaaccugagagacagguacuaccggugugaccgcaaccugguuuggaaugcgggugcgcugcacuacagugacgagguggagaucauccgagggcucacgcgcaugcccaguggccgcgaugagcucaaggccagcguggaugcggucaaguacuucgggaaaggcaccuacaccgacugcgccauuaagaaggggcuggaggagcugcucauagggggcucccaccugaaggagaacaaguacuugaucguggugaccgacgggcauccucuagagggcuacaaggaaccaugcgggggucuggaagaugcaguaaaugaggccaaacaccugggcaucaaggucuuuucuguggccaucacaccugaccaccuggagccacgucuaaguaucauugccacagaccacacauaccggcgcaauuucacggcagcugacugggggcauagccgcgaugcagaagaggucaucagccagaccauugacaccauuguggacaugauuaaaaauaacguggaacaaguguguuguucuuuugagugccaggcugccagaggaccuccagggccccgaggcgacccuggguaugagggggagcgaggaaagccaggucuuccgggagagaagggagaagcuggagacccuggacgaccuggggaucuuggaccagucggguaccaggguaugaagggagaaaaggggagccguggagagaaggguuccagaggaccgaaagguuacaagggcgagaaaggcaagcgcggaaucgacggggucgacggcaugaagggagagacgggguacccaggacuaccgggcugcaagggcuccccaggauuugauggcauucaaggacccccgggucccaagggugaugcuggugccuuugggaugaagggagaaaagggugaagcuggagcagacggugaggcugggagaccagggaacucagggucaccuggagaugagggugauccuggagagccugguccccccggagaaaaaggagaggccggugaugaaggaaaugcuggcccagacggugccccuggagagagggguggcccuggugaaagaggaccucgggggaccccuggugugagaggaccaaggggagacccgggugaagcuggaccacagggugaccaaggaagagaggggcccgucggcaucccuggagacucgggugaggcuggccccauuggaccuaaaggauaccgaggugaugaggguccuccagguccugagggccucagaggagccccaggaccuguugguccuccuggagaccccggacugaugggugagagaggugaggauggaccaccaggaaacggcacggaagguuuccccggcuucccuggguauccaggcaacagaggcccuccugggcuaaauggcacaaaaggcuacccuggccucaagggggaugagggugaagugggagacccaggagaggauaacaacgacauuucaccccguggggucaaaggggcaaagggauaccgaggcccagaaggaccccagggaccuccaggacaugugggaccaccugggccagaugagugugagauccuggauaucaucaugaaaaugugcuccugcugugagugcacauguggacccauugacauccucuucgugcuggacagcucggagagcauuggccuacagaacuuugagauugccaaggacuucaucaucaaggucauugaccgguugagcaaggaugagcuggucaaauuugagccagggcagucucacgcgggcgugguacaguacagccacaaccagaugcaagagcacguggacaugcggagccccaacguccgcaacgcccaggacuucaaagaagcugucaagaagcuacaauggauggcugguggcacauucaccggagaagcgcugcaguacacccgggaccggcuacucccacccacacagaacaaccgaauugcccuggucauuacggauggacguucugacacucaacgggacacgacaccucucagugugcucuguggugcagacauucagguaguuucugugggaaucaaggauguguuuggcuuuguggcgggcuccgaccagcucaaugucauuuccugccaaggcuuaucgcaaggucguccagguaucucccuggugaaggagaacuaugcagagcuucucgaugacggcuuucugaagaacauaacagcccagaucuguauagauaagaaguguccggauuauaccuguccaaucacauucuccuccccggcugacaucaccauccugcuagacagcucagccagugucggcagccacaacuucgaaaccaccaaggucuucgccaagcgccuagcugagcgauuccugucagcaggcagggcggauccuucccaggaugugcggguggccgugguacaguauaguggccaggggcagcaacagccaggucgggcggcucuucaguucuuacagaauuacacagugcuggccagcucuguggacagcauggauuucaucaacgacgccacagacgucaacgaugcucugagcuacgugacucguuucuaccgggaagccucgucaggugccaccaagaagagagugcuguuguuuucagacggcaacucucagggggccacagcagaggccauugagaaggcugugcaggaggcccagcgugcaggcauugagaucuuuguggugguggugggaccccaggugaacgagccccacauccgugugcuugucacuggcaagacugcagaguacgacguggccuuuggcgagcgccaccuauuccguguaccaaacuaccaggcccugcuacguggcguacucuaccagacagucuccaggaagguggcacugggcuagagggccacacacguggcuggacacacauggcauggagacacauuucaacaggccuucccgcccuucccacugacaaaacaggaauaggaaaugugacccaacuggucaacucaacugucuuaaagggaacgcugagaugcacacucuuugcuuuguguaauguccccuguggcucaccugagcuccuaucuagaucccgcccuugguuuguacaucaugguggccaucuugcugaccccucccccaucugggacuggauccagccaucucgucuuccuccucacugccccuaaccuauccguggugucuucacaccaucacugcaguuuccgucuguguucugucuuccaugcucaacaugaagcagaccuucucaugaguucagcuugcuggauuauggcuuuuaggaaauugaacacaggaggaguuccaaacacaaacuuggaggagaccccuccucuucaucaggugcuugucagugaccuacaugcaucuuggucugguccuuaguggcuaguccuuccacucugaaagcaaaggugcuaucuaucuguaagggcucucucuacacacccagaggcuuagcuuggacaguucacacucaaguguccugucagaaucaauccagagcuuucucccucaaaauagugacuugucucccccugguccccaaaggcuccccuuuaguuaguuucuucauggcucccccacauuccccguaaucugauccaagccagcuaucucugcuaauaaagguuuccauuuuucaaaaaaaaaaaaaa

SEQ ID NO: 252 - RNA, 235 nt, Homo sapiens
accccaugccccacccccaccuucgauguuuugaacauuucuaacaacugaagccaguaaagucauauucuuuaaauuuccaggacauucauauuauucacauaaucauggucauggugaugauggaaacugaggacuuuaaaagagauuuucccuucccaaacguuucuggacaguaccugauuguauuuuuuuuguuuuguuuuguuuuuuaauaaaagcacaguacuuuucc

SEQ ID NO: 253 - RNA, 2005 nt, Homo sapiens
gucugcccugccguuucucuacuucccagccuucucaucuccaggaaccaugucuaccaaaaccaccaucaaaagucaaaccagccaccguggcuacagugccagcucagccagagugcuuggacucaaccgcucgggcuucagcaguguguccgugugccgcucccggggcagcgguggcuccagugcaauguguggaggagcuggcuuuggcagcaggagccucuaugguguggggagcuccaagaggaucuccaucggagggggcagcuguggcauuggaggaggcuauggcagccgauucggaggaagcuucggcauuggugguggagcugguaguggcuuuggcuucggugguggagcuggcuuuggugguggcuaugggggagcuggcuucccggugugcccacuuggaggcauccaagaggucaccaucaaccagagccuccucacaccccugaaccugcaaauugaccccaccauccagcgggucaggacugaggagagggagcagaucaagacccucaauaacaaguuugccuccuucaucgacaaggugcgguucauggagcagcagaacaaggucauggacaccaagugggcccugcugcaagagcaggacaccaagaccgugaggcagaacauggagcccauguuugagcaguacaucagcaaccuccgcagacagcuggacagcaucauuggagagaggggucgcaugaacucagagcugaggaacaugcaggaacucguagaagaacuacggaacaaauaugaagaugaaaucaacaagcgcacagacgcagagaaugaauucgugacccugaagaaggauguagaugcugccuacaugaacaaaguugaacugcaagccaaggcagacagucuaacagaugauaucaacuucuugagagcucucuaugaagcagaacugucucagaugcaaacucacaucucagacacaucugugguccucuccauggucaacaaccguagccucguccuagacagcaucaucgcugaggucaaggcccaguuugaggucauagcucagagaagucgggcugaagcugagucauuguaccagacuaaauaugaggagcugcaggucacagcuggcagacauggggacgaccugcgcaacaccaagcaggagauugcugagaucaaccgcaugauccagaggcugagaucugagaucgaccacguuaagaagcagugugccaaccugcaagcugcuauugcugaugcugagcaacguggggagauggcccugaaggaugcaaggggcaagcuggaagggcuggaggaugcccugcagaaggccaaacaggacauggccaugcugcugaaggaguaccaugaacucaugaaugucaagcuggcccuugauguggaaauugccaccuacaggaagcugcuggaaggagaggagugcagguugaauggugaagguguuggaccagucaacaucucuguggugcaguccaccguguccagcggcuauggcagugccgggggugccagcagcagcuuaggcauggguggaggcagcagcuacuccuauagcagcagccauggccuuggagguggcuucagugcuggcaguggcagagccaucggagguggccucagcucuucugguggccucagcucuucuaccaucaaauacaccaccaccuccuccagcaagaagagcuacaggcagugaauucugucaccaagagcuugucucuggucccagaugucauggcugcagcugaaccacaugcuuugguucccggaagggaacgaaucccaaccucuggccuccccauggcucaguucuacauuuguguugcacgucagcaccuauacauguucuuuggugacccagaccccaaaauguugcagaauguagaccuccaagacgaaaccccaaacccuacccagaauacccaccuaaauucugucaugguucugacuuccuccagagucuguaaaauaaaaugcccccacaacaaac

SEQ ID NO: 254 - RNA, 357 nt, Homo sapiens
uuuuuuuuuuuuuuuuugauuuuaauuacaaacuuuauuuguccuccaguucacaguuuauacgugguacaucccaccaugucagcuuccagaacggcuauucaggagauggguggagcuuucuuuguaaaggaacccgacauuuuaaaauuuugguuagaaucuucauagguuuauaaaaguacucucugcaagcgaacuggauauauuuacauuuauagcuuaaauucaaauuuuggaaaauaggaaucuuuuuguguuuuuaaacauccuggguuuaugucuuaagacuuuacucugaaugccacaugaucacguaagcccaagccucccccagaagggaaaaaucaguuuugc

SEQ ID NO: 255 - RNA, 271 nt, Homo sapiens
uuuuuuuuuuuuuuuuugggugccaugccacagcaaggggccuuuauuagauguucagggcacagacagguggaugcuagaugguguagcacaccuucucaggguggaguggugccuggauguccaguuugcgggucuugcuguccuuaucaaugaucuccagucgcaauguagguggacgcuucucagccuggggugagggcagcucacggcucuugaggaggugcuuguccgaauccuccacagugauacccagggugcaacccccugg

SEQ ID NO: 256 - RNA, 255 nt, Homo sapiens
uuuuuuuuuuuuuuucugacacaguaguaauccuuccagacuccuuacacaauauuacaacucccccaguacauaaauguuccuauaccaugcacacagcaacaugggguccacugaugucgcaggcgacuuuucuaaugguggaacauagcaccucaaguucugccaucuacacagugaagggacgugauggucggggcuccagagugacagcaaacugccucuugggugacacgcuuguggcgaagugccucc

SEQ ID NO: 257 - RNA, 4031 nt, Homo sapiens
gagaauguugcugaggagguggggcugcugcagcuccuuggagacccccuaccugagaagaucucacaaaucgaugacccucacgucgggccggccuacaucuuuggaccagacuccaacaguggccagguggcccaguaucauuucccaaaacucuucuuccgggacuuuucgcugcuguuucauguccggccagccacagaggcagcaggggugcuauuugccaucacagaugcugcccaggugguagucucacugggcgugaagcucucagagguccgagauggacagcaaaacaucucauugcucuacacggagccuggggccagccagacccagacgggagccagcuuccgccuaccugcauuuguugggcaguggacacacuucgcgcucagcgucgacggaggcucuguggcucucuacguagacugugaagaauuccagagggugccauuugcucgggccucgcagggacuggagcuagagcguggcgcuggccucuuugugggucaggcuggaacagcagacccugacaaguuccaggggaugaucucagagcugaagguacgcaaaaccccccgggugagcccugugcacugucuggaugaagaagaugaugaugaagaccgggcaucuggagauuuuggaaguggcuuugaagaaagcagcaagucacacaaggaggauacaucucuacuaccugggcucccucagccaccuccugucacuuccccaccccuggcuggaggcagcaccacagaagauccuagaacagaagaaacggaggaagacgccgcgguagauucuauaggagcugagacccuuccuggcacagguucaagcggugcaugggaugaggcuauccagaaccccggaaggggcuugauaaagggagguaugaaaggacaaaagggagaaccaggugcccagggcccaccuggcccagcuggcccccaggguccugccgguccagugguccagagccccaacucacaaccugucccuggagcacaaggacccccgggaccucaggggccaccagggaaggauggcacuccaggaagggauggugaaccgggugacccuggugaagaugggagaccgggugacacuggaccucaaggcuuuccagggaccccaggagaugugggcccuaagggcgagaagggagauccugguauugggccccgaggaccuccagggccuccagggccaccaggacccuccuucagacaagacaagcugaccuucauugacauggagggauccgguuucagcggagacauagagagccuuagaggcccacgaggcuucccuggccccccggggcccccuggugucccaggacuuccuggugagccaggacgcuuugggaucaaugguuccuaugcaccaggaccugcaggccuuccugguguaccugggaaggaaggaccccccgguuuuccaggucccccgggaccuccagguccuccaggcaaagagggcccaccaggaguggccggccagaaaggcaguguuggugaugugggcaucccaggacccaaggggagcaaaggagaccuugggcccaucgguaugccuggcaagucuggcuuggcuggauccccugggccaguuggacccccaggaccuccagggccuccagggccaccaggaccaggauuugcugcuggauucgaugauauggaaggcucuggaauaccccucuggacaacagcccgaagcucugaugggcugcagggaccucccgggucgccgggacucaagggggauccuggaguggcaggccuaccuggagccaagggagaaguuggagcagauggagcccagggcaucccuggucccccaggaagagaaggugcagcuggaucuccggggccaaaaggagagaaggggaugccgggagaaaagggaaacccaggaaaagauggagugggccggccgggccucccugggccuccaggaccuccagggcuggugaucuaugugucaagugaggauaaagcaauagugagcacgccaggaccugagggcaagccaggguacgcaggcuuuccuggaccugcuggaccgaagggugaccuggguuccaaaggcgagcagggucuuccgggguuuaagggugagaagggagagccaggcacuaucuuuaguccugauggcagacgucugggccauccccagaagggagccaagggagagccaggcuuucgaggacccccggguccuuauggacgaccugggcacaagggugaaauuggcuucccuggacggccgggucgaccuggaacgaauggcuuaaagggagagaagggagagccuggagaugccagccuuggguucagcaugaggggauugccuggccccccugggccuccaggacccccagguccuccugggaugcccaucuaugacagcaaugcauuuguggagucuggccgaccuggacuaccaggacagcagggugugcaggggccuucaggaccaaagggugacaaaggagagguggggccaccugggccaccagggcaauuccccauugaccucuuccaccuggaagcggaaaugaagggggacaagggagaccgaggggaugcuggacagaaaggagagaggggagaaccuggggcuccuggugguggauucuucagcucaaguguaccuggcccacccggcccaccuggauacccuggaauuccggguccaaagggagagagcauccgggggccaccuggcccuccuggcccgcagggaccuccuggcauuggcuaugagggucgccagggucccccaggaccuccaggaccuccaggaccucccuccuucccuggcccucacagacagacugucaguguuccugguccuccgggcccaccugguccuccaggucccccaggagccaugggugccucugcugggcaggugaggaucugggccacauaccagaccaugcuggacaagauccgggaggugccggagggcuggcucaucuuuguggccgagagggaagagcucuauguacgcguuagaaauggcuuccggaaggugcugcuggaggcccggacagcccuccugagaggcacgggcaaugagguggcugcuuuccagcccccauugguccagcuucaugagggcaguccauacacccggagggaguacuccuauuccacggcacgacccuggcgagcagaugacauccuggccaacccaccgcgccugccagaccgccagccuuacccuggaguuccacaucaccacaguuccuaugugcaccugccgccagcccgccccacccucucacuugcucauacucaucaggacuuucagccagugcuccaccugguggcacugaacaccccccugucuggaggcaugcgugguauccguggagcagauuuccagugcuuccagcaagcccgagccguggggcugucgggcaccuuccgggcuuuccuguccucuaggcugcaggaucucuauagcaucgugcgccgugcugaccgggggucugugcccaucgucaaccugaaggacgaggugcuaucucccagcugggacucccuguuuucuggcucccagggucaagugcaacccggggcccgcaucuuuucuuuugacggcagagauguccugagacacccagccuggccgcagaagagcguauggcacggcucggaccccagugggcggaggcugauggagaguuacugugagacauggcgaacugaaacuacuggggcuacaggucaggccuccucccugcugucaggcaggcuccuggaacagaaagcugcgagcugccacaacagcuacaucguccugugcauugagaauagcuucaugaccucuuucuccaaauaggccucugccagcuaggguggcagacagaggccaugcagaacuuugacacagcgcagggagcauucagucagcacccagggcucuggcugggauacaacuccuguauaguucccauuuuuauguaauccucaagaaauaaaaggaagccaaagaguaaaaaaaaa

SEQ ID NO: 258 - RNA, 1503 nt, Homo sapiens
aacugccuucgagaagcguuagccuagagauccgagccucuucuccauaccauaguugguucaggugguuuccucuucaaaccuugcgucugcggauaauccgcgcggccgggcguuaagcuccaggucccugucgcuccgucgagguggcaagccauggccggcugcugcuguuugucugcggaggagaaagagucucagcgcaucagcgcggagaucgagcggcacguucgccgcgacaagaaggacgcgcgccgggagcucaagcugcuguugcugggaaccggugagagugggaaaagcaccuuuaucaagcagaugaggauaauccaugggucuggcuacagugaugaagauagaaagggcuucacgaagcugguuuaccaaaacauauucacggccaugcaagccaugaucagagcaauggauacccugaggauacaauacaugugugagcagaauaaggaaaaugcccagaucaucagggaaguggaaguagacaaggucacugcacucucuagagaccagguggcagccaucaagcagcuguggcuggaucccggaauccaggaguguuacgacaggaggagggaguaccagcugucagacucugccaaauauuaccugacggacauugagcguaucgccaugcccucuuucgugccaacacaacaggaugugcuucguguuagagugcccaccacuggcaucauagaauauccauucgaccuggaaaacaucaucuuccgaaugguggauguugguggccagcgaucugaacgacggaaauggauucacugcuuugagagugucaccuccaucauuuucuugguugcucugagugaauaugaccagguucuggcugagugugacaaugagaaccgcauggaggagagcaaagcccuguuuagaaccaucaucaccuaccccugguuucugaacuccuccgugauucuguucuuaaacaagaaggaucuucuagaggagaaaaucauguacucucaucuaauuagcuacuucccagaguacacaggaccaaagcaagaugucaaagcggccagggacuuuauccugaagcuguaucaagaccagaauccugacaaagagaagguuaucuauucucacuucacuugugcuacagacaccgagaauauccgcuuuguguuugcugcugucaaagacacaauccuacagcuaaaccuacgggaguucaacuugguguaaauggagggccuacuccuccgagacagagggugaucugagcccuuccugccugaucuacaagugcuucuggaccaggaccuaaggacauuauguagcccacaggacagagauggguagugcaaugugaaaaauacuucaccaacccuuuuaagugucuuuaauucuucacugucuaacucuuuucucgccuuuugguugaacgauuagguaucauuuuugagugguucccccucuccuauuuuuuuaaacuaguguucaacaguuauuaaaaaaucaugc

SEQ ID NO: 259 - RNA, 876 nt, Homo sapiens
gaauucccugcaaccuugucugagaggaagcaaggacuggugugaggagggagcugugagguuuuaucugugcagcccuucucugaggauggacacuucucacacuacaaaguccuguuugcugauucuucuuguggcccuacugugugcagaaagagcucagggacuggaguguuaccagugcuauggagucccauuugagacuucuugcccaucaauuaccugccccuacccugauggagucuguguuacucaggaggcagcaguuauuguggguucucaaacaaggaaaguaaagaacaaucuuugcuuacccaucugcccuccuaauauugaaaguauggagauccuggguacuaaggucaaugugaagacuuccuguugccaggaagaccucugcaaugcagcaguucccaauggaggcagcaccuggaccauggcaggggugcuucuguucagccugagcucaguccuccugcagaccuugcucugaugguccucccaaugaccuccacccuuguccuuuuauccucaugugcaacaauucuuccuggagcccucuagugaugaauuaugaguuauagaagcuccaaggugggaguagugugugaaauaccauguuuugccuuuauagcccugcuggguagguaggugcucuaauccucucuagggcuuucaagucuguacuuccuagaaugucauuuuguuguggauugcugcucaugacccuggaggcacacagccagcacagugaagaggcagaauuccaagguauuaugcuaucaccauccacacauaaguaucugggguccugcaauguucccacauguauccugaaugucccccuguugaguccaauaaacccuuuguucuccc

SEQ ID NO: 260 - RNA, 6929 nt, Homo sapiens
  misc_feature (2080)..(2080): n is a, c, g, or u
  misc_feature (2082)..(2082): n is a, c, g, or u
  misc_feature (4019)..(4019): n is a, c, g, or u
  misc_feature (4119)..(4119): n is a, c, g, or u
  misc_feature (5039)..(5039): n is a, c, g, or u
  misc_feature (5048)..(5048): n is a, c, g, or u
  misc_feature (5054)..(5054): n is a, c, g, or u
  misc_feature (5079)..(5079): n is a, c, g, or u
  misc_feature (5131)..(5131): n is a, c, g, or u
ggaagaaagagagggagggaaaagagaaggaaggaguagaugugagaggguggugcugagggugggaaggcaagagcgcgaggccuggcccggaagcuaggugaguucggcauccgagcugagagaccccagccuaagacgccugcgcugcaacccagccugaguaucuggucuccgucccugaugggauucucgucuaaaccgucuuggagccugcagcgauccagucucuggcccucgaccagguucauugcagcuuucuagagguccccagaagcagcugcuggcgagcccgcuucugcaggaaccaauggugagcagggcaaccuggagaggggcgcuauucugaggauucgaggugcacccguaguagaagcuggggauggggcucaggcuguaaccgaggcaaaaguuggccuauuccuccuuccuucuccaacaguguuggaggugggaugauggaggcuaaaaggcaccuccauauauguuacugcgucuaucaaccuacuuuagggaggugcgggccaggagaggcgggaaggagagaaggccuuggaagagaggucauugggaagaacugugggguuugguggguuugcuuccacuuagacuauaagagugggagaggagggagucaacucuaaguuucaacaccagugggggacugaggacugcuucauuaggagagagaaccuagccagagcuagcuuugcaaaagaggcuguaguccugcuuugcucuaaagcgcgacccgggauagagaggcuuccuugagcggggugucaccuaaucuuguccccaacgcacccccucccagccccugagagcuagcgaacuguagguacacaacucgcucccaucuccaggagcuauuuucuuagacaugggcacccaugauucugccuucugguacucuccccucccugggaaagggguguaagguuccgacggaaccguggccaggaugccgaaaggcuaccugugcgggucuucugccaugcugugucugugcggacaugccagcagggcuaaugaggagcuugcgauacuccaaaggguucgggaauugcgggguccuuacacgcaguggaguugggccccuuuuacucagaagguuuccgccacggcuuugguugauaguuuuuuuaguauccugguuuaugaacugaagguuuugugagauguugaaucacuagcagggucauauuuggcaaaccgaggcuacuauuaaauuuugguuuuagaagaagauucuggggagaaagugaaggguaacugccuccaggagcuguaucaaccccauuaagaaaaaaaaaaauaccaggagaugaaaauuuacuuugaucuguauuuuuuaauuaaaaaaaaucagggaagaaaggagugauuagaaagggauccugagcgucggcgguuccacggugcccucgcuccgcgugcgccagucgcuagcauaucgccaucucuuucccccuuaaaagcaaauaaacaaaucaacaauaagcccuuugcccuuuccagcgcuuucccaguuauucccagcggcgacgcgugucggggaauagagaaaucgucucagaaagcugcgcugaugguggugagagcggacugucgcucaggggcgcccgcggucucugcacccagggcagcagugugggauggcgcugggcagccaccgccgccaggaaggacgugacucuccauccuuuacacuucuuucucaaagguuucccgaaagugccccccgccucgaaaacuggggccggugcggggggggggagagguuagguugaaaaccagcuggacacgucgaguuccuaagugaggcaaagaggcgggguggagcgggcucuggagcgggggaguccugggacucgguccucggauggaccccgugcaaagaccuguuggaacaagaguugcgcuuccgagguuagaacaggccaggcaucuuaggauagucaggucacccccccccccaaccccacccgaguuguguuggugaauuucuuggaggaaucuuagccgcgauucuguagcuggugcaaaaggaggaaaggggugggggaaggaaguggcngngcggggguggcgguggggguggaggugguuuaaaaaguaagccaagccagagggagaggucgagugcaggccgaaagcuguucucggguuuguagacgcuugggaucgcgcuuggggucuccuuucgugccggguaggaguuguaaagccuuugcaacucugagaucguaaaaaaaaugugaugcgcucuuucuuuggcgacgccuguuuuggaaucuguccggaguuagaagcucagacguccaccccccaccccccgcccacccccucugccuugaauggcaccgccgaccgguuucugaaggaucugcuuggcuggagcggacgcugagguuggcagacacgguguggggacucuggcggggcuacuagacaguacuucagaagccgcuccuucuaacuuucccacaccgcucaaaccccgacacccccgcggcggacugaguuggcgacggggucagagucuucuggcugaaaguuagauccgcuaggggucggcugccugucgcuagaagcauuauuuggccucucggagacccguguggaggaagugcuggagugugcgaguguguuugcgugugugugugugugugugugugugugugugugugugugugugugcgcgcgcccuuggagggucccuaugcgcuuuccuuuucauggaacgcugucgugaggcuuugguaaacugucuuuucgguuccucucucggcugcacuuaagcuuugucggcgcuguaaagagacgcgucuucaagugcacccugauccucaggcuucagauaacccguccccgaaccuggccagaugcauugcacugcgcgccgcagguagagacgugccccacguccccugcgugcagcgacuacgaccgagagccgcgccaguguggugucccgccgagaguuccucagagcaggcggggacaacucccagacggcuggggcuccagcugcgggcgcggagguuggccucgcucgcaggggcuggacccagccggggugggaggauggaggaggggcgggcgggcucuucggugaguggggcggggccucuggguccacgugacuccuaggggcuggaagaaaaacagagccugucugcuccagagucucauuauaucaaauaucauuuuaggagccauuccguagugccauucggagcgacgcacugccgcagcuucucugagccuuuccagcaaguuuguucaagauuggcucccaagaaucauggacuguuauuaugccuuguuuucugucagugaguagacaccucuucuuucccuucuugggauuucacucuguccucccaucccugaccacugucugucccucccgucggacuuccauuucagugccccgcgcccuacucucaggcagcgcuaugguucucuuucuggucccugcaaggccagacacucgaaauguacgggcuccuuuuaaagcgcucccacuguuuucucugauccgcugcguugcaagaaagagggagcgcgagggaccaaauagaugaaagguccucagguuggggcugucccuugaagggcuaaccacucccuuaccagucccgauauauccacuagccugggaaggccaguuccuugccucauaaaaaaaaaaaaaaaaacaaaaaacaaacagucguuugggaacaagacucuuuagugagcauuuucaacgcagcgaccacaaugaaauaaaucacaaagucacuggggcagccccuugacuccuuuucccagucacuggaccuugcugcccgguccaagcccugccggcacagcucuguucuccccuccuccuguucuuaaccagcuggaaguuguggaaauugggcuggagggcggaggaagggcggggguggggggguggagaaggugggggggggggaggcugaagguccgaagugaagagcgauggcauuuuaauucucccuccnccuccccccuuuaccuccucaauguuaacuguuuauccuugaagaagccacgcugagaucauggcucagauagccguugggacaggauggaggcuaucunauuugggguuauuugaguguaaacaaguuagaccaaguaauuacagggcgauucuuacuuucgggccgugcauggcugcagcugguguguguguguguagggugugagggagaaaacacaaacuugaucuuucggaccuguuuuacaucuugaccgucgguugcuaccccuauaugcauaugcagagacaucucuauuucucgcuauugaucgguguuuauuuauucuuuaaccuuccaccccaacccccuccccagagacaccaugauuccugguaaccgaaugcugauggucguuuuauuaugccaaguccugcuaggaggcgcgagccaugcuaguuugauaccugagaccgggaagaaaaaagucgccgagauucagggccacgcgggaggacgccgcucagggcagagccaugagcuccugcgggacuucgaggcgacacuucuacagauguuugggcugcgccgccguccgcagccuagcaagagcgccgucauuccggauuacaugagggaucuuuaccggcuccagucuggggaggaggaggaggaagagcagagccagggaaccgggcuugaguacccggagcgucccgccagccgagccaacacugugaggaguuuccaucacgaaggucaguuucugcucuuaguccuggcgguguagggugggguagagcrccggggcagaggguggggggugggcagcuggcagggcaagcugaagggguuguggaagcccccggggaagaagaguucauguuacaucaaagcuccgaguccuggagacuguggaacagggccucuuaccuucaacuuuccagagcugccucugaggguacuuucuggagaccaaguagugguggugaugggggaggggguuacuuugggagaagcggacugacaccacucagacuncugcuaccncccagnggguguucuuuagcuauaccaaagncagggauucugcccguuuuguuccaaagcaccuacugaauuuaauauuacancuguguguuugucagguuuaucaauaggggccuuguaauacgaucugaauguuuccuagcggauguuucuuuuccaaaguaaaucugaguuauuaauccuccagcaucauuacuguguuggaauuuauuuucccuucuguaacaugaucaacaaggcgugcucuguguuucuaggaucgcuggggaaauguuugguaacauacucaaaaguggagagggagagaggguggccccucuuuuucuuuacaaccacuuguaaagaaaacuguacacaaagccaagagggggcuuuaaaaggggaguccaagggugguggaguaaaagaguugacacauggaaauuauuaggcauauaaaggagguugggagauacuuucugucuuugguguuugacaaaugugagcuaaguuuugcugguuugcuagcugcuccacaacucugcuccuucaaauuaaaaggcacaguaauuuccuccccuuagguuucuacuauauaagcagaauucaaccaauucugcuauuuuuuguuuuuguuucuuguuuuuguuuuguuugguuuuuuuuuuuuuuuuuuuuuuuuugucucagaaaagcucaugggccuuuucuuuuccccuuucaacugugccuagaacaucuggagaacaucccagggaccagugagagcucugcuuuucguuuccucuucaaccucagcagcaucccagaaaaugaggugaucuccucggcagagcuccggcucuuucgggagcagguggaccagggcccugacugggaacagggcuuccaccguauaaacauuuaugagguuaugaagcccccagcagaaaugguuccuggacaccucaucacacgacuacuggacaccagacuaguccaucacaaugugacacggugggaaacuuucgaugugagcccugcaguccuucgcuggacccgggaaaagcaacccaauuaugggcuggccauugaggugacucaccuccaccagacacggacccaccagggccagcaugucagaaucagccgaucguuaccucaagggaguggagauugggcccaacuccgcccccuccuggucacuuuuggccaugauggccggggccauaccuugacccgcaggagggccaaacguagucccaagcaucacccacagcgguccaggaagaagaauaagaacugccgucgccauucacuauacguggacuucagugacgugggcuggaaugauuggauuguggccccacccggcuaccaggccuucuacugccauggggacugucccuuuccacuggcugaucaccucaacucaaccaaccaugccauugugcagacccuagucaacucuguuaauucuaguaucccuaaggccuguuguguccccacugaacugagugccauuuccauguuguaccuggaugaguaugacaaggugguguugaaaaauuaucaggagauggugguagagggguguggaugccgcugagaucagacaguccggagggcggacacacacacacacacacacacacacacacacacacacacacacacguucccauucaaccaccuacacauaccacacaaacugcuucccuauagcuggacuuuuaucuuaaaaaaaaaaaaaagaaagaaagaaagaaagaaagaaaaaaaaugaaagacagaaaagaaaaaaaaaacccuaaacaacucaccuugaccuuauuuaugacuuuacgugcaaauguuuugaccauauugaucauauuuugacaaauauauuuauaacuacauauuaaaagaaaauaaaaugag

SEQ ID NO: 261 - RNA, 277 nt, Homo sapiens
gaaucccacuuacaugcgagcaucucuauauacauccucaaucuauccccucgaauccacggacuuaucagucaaucaauacuacagucaaagaauuuuuuucuacguuauccuggagcauugcgcuggcaccucuuuuucuaaucaucuugguuguggggccaauauggaugcgcagacgguguaaacgcagggcuggaaagacauauggacugaccaagcuacggacugacaaccaggacuucccuuccagcccaaacuaaauaaaggaaaugaa

SEQ ID NO: 262 - RNA, 2810 nt, Homo sapiens
gaauucaugucuuacggucaaggcagagggcccagcgccacugcagccgcgccaccucccagggccgggccagcccaggcguccgcgcucucgggguggacuccccccgcugcgcgcucaagccggcgauggcuccucucggauaccucuuagugcucugcagccugaagcaggcucugggcagcuacccgaucuggugguccuuggcugugggaccccaguacuccucucugagcacucagcccauucucugugccagcaucccaggccugguaccgaagcagcugcgcuucugcaggaacuacguggagaucaugcccagcguggcugagggugucaaagcgggcauccaggagugccagcaccaguuccgaggccggcguuggaacugcaccaccgucagcaacagccuggccaucuuuggcccuguucuggacaaagccacccgggagucagccuuuguccaugccaucgccuccgcuggaguagcuuucgcagugacacgcuccugugcagagggaucagcugcuaucugugggugcagcagccgccuccagggcuccccaggcgagggcuggaaguggggcggcuguagugaggacauugaauuuggaggaauggucucucgggaguuugccgaugccagggagaaccggccggaugcccgcucugccaugaaccgucacaacaaugaggcugggcgccaggccaucgccagucacaugcaccucaagugcaaaugccacgggcuaucuggcagcugugaagugaagaccugcugguggucgcagccggacuuccgcaccaucggggauuuccucaaggacaaguaugacagugccucggagauggugguagagaaacaccgagagucucguggcuggguggagacccugaggccacguuacacguacuucaaggugccgacagaacgcgaccuggucuacuacgaggccucacccaacuucugcgaaccuaaccccgaaaccggcuccuucgggacgcgugaccgcaccugcaaugugagcucgcauggcauagaugggugcgaccuguugugcugcgggcgcgggcauaacgcgcgcacugagcgacggagggagaaaugccacuguguuuuccauuggugcugcuacgucagcugccaggagugcacacgugucuaugacgugcacaccugcaaguaggagagcuccuaacacgggagcaggguucauuccgaggggcaagguuccuaccugggggcgggguuccuacuuggaggggucucuuacuuggggacucgguucuuacuugagggcggagauccuaccugugagggucucauaccuaaggacccgguuucugccuucagccugggcuccuauuugggaucuggguuccuuuuuaggggagaagcuccugucugggauacggguuucugcccgaggguggggcuccacuuggggauggaauuccaauuugggccggaaguccuaccucaauggcuuggacuccucucuugacccgacagggcucaaauggagacagguaagcuacucccucaacuaggugggguucgugcggaugggugggaggggagagauuagggucccuccucccagaggcacugcucuaucuagauacaugagagggugcuucagggugggcccuauuugggcuugaggaucccgugggggcggggcuucaccccgacuggguggaacuuuuggagacccccuuccacuggggcaaggcuucacugaagacucaugggauggagcuccacggaaggaggaguuccugagcgagccugggcucugagcaggccauccagcucccaucuggccccuuuccaguccugguguaagguucaaccugcaagccucaucugcgcagagcaggaucuccuggcagaaugaggcauggagaagaacucaggggugauaccaagaccuaacaaaccccgugccuggguaccucuuuuaaagcucugcaccccuucuucaagggcuuuccuagucuccuuggcagagcuuuccugaggaagauuugcagucccccagaguucaagugaacacccauagaacagaacagacucuauccugaguagagaggguucucuaggaaucucuauggggacugcuaggaaggauccugggcaugacagccucguaugauagccugcauccgcucugacacuuaauacucagaucucccgggaaacccagcucauccgguccgugauguccaugccccaaaugccucagagauguugccucacuuugaguuguaugaacuucggagacauggggacacagucaagccgcagagccaggguuguuucaggacccaucugauuccccagagccugcuguugaggcaauggucaccagauccguuggccaccacccugucccgagcuucucuagugucugucuggccuggaagugaggugcuacauacagcccaucugccacaagagcuuccugauugguaccacugugaaccgucccucccccuccagacaggggaggggauguggccauacaggagugugcccggagagcgcggaaagaggaagagaggcugcacacgcguggugacugacugucuucugccuggaacuuugcguucgcgcuuguaacuuuauuuucaaugcugcuauauccacccaccacuggauuuagacaaaagugauuuucuuuuuuuuuuuuucuuuucuuucuaugaaagaaauuauuuuaguuuauaguauguuuguuucaaauaauggggaaaguaaaaagagagaaaaaaaaaaaaaaaaaaaaaaaaaaaaaaaaaaaaaa

SEQ ID NO: 263 - RNA, 2948 nt, Homo sapiens
cgcaccggagguccacacugccgcguggacuccagcgauggcgcugcgcuaggcuagcgggugccaggaucccucucugcguccugugcgcgggaagagcucuggagaaccagaguugcauucuggaguugaagacucauggcacagacuguuagagaaugcucauuggcacuucuuuuuuuguucauguggcugcugauuaaagcaaauauagaugugugcaagcuuggcacugugaccguccagccugccccugugauuccucuugggucagcugccaauauuuccugcuccuugaaucccaagcaaggcuguucacauuaucccaguucuaacgaauuaauccucuuaaaguuugucaaugauguccuuguugaaaaucuccauggcaagaaaguccaugaccacacuggucacuccuccacuuuucaagucaccaaccugucccuugguaugaccuuguuugucugcaagcuaaacuguagcaacucucaaaagaagccaccagucccaguaugugggguggagaucucaguugguguugcuccagagccaccucaaaacauaucauguguccaggaaggagaaaauggaacuguggccuguuccuggaacucuggaaaaguuacuuaucugaaaaccaauuacacuuuacaguuaaguggaccaaacaaucugaccugucagaaacaauguuuuucugacaaucgucagaauugcaaucgccuggaucuugggaucaaucuaagcccugauuuagcugaauccagguucauaguccguguuacugccaucaacgaucuuggaaauucuucuucacuuccgcauacguucacguucuuggacauagugaucccucuuccuccgugggacaucagaaucaacuuucuaaaugcuucugggagcagagguacacugcagugggaagaugaggggcaagugguacucaaucaacucagauaucagccucuuaacagcacguccuggaacauggucaaugcuacaaaugccaaaggaaaauaugaccugcgagaucugagaccguuuacagaauaugaauuucaaaucuccucuaagcuacaucucucuggaggaaguuggaguaauuggagugagucacugagaacacgaacaccagaggaagagccuguugggauauuagacaucugguacaugaaacaagacaucgacuaugacagacagcagaucucucuuuucuggaagagucugaauccaucagaggcaagggggaagauccuccacuaucaggugacguuacaagaggugacaaagaaaacaacacugcagaauacuacaagacacaccuccuggaccagggucaucccccgaacuggggcuuggacggcaucagugucugcagccaacucaaaaggcgcuucugcacccacucacauuaacauaguggaccuauguggcacuggguugcuggcuccucaccaggucucugcaaagucggagaacauggacaacauucuagugaccuggcagccuccuaagaaagcugauucugcuguucgggaguacauaguggaauggagagcucuccaaccagggagcaucacgaaguuucccccacacuggcugcggauccccccggacaacaugucugcucugauuucagagaacauaaagcccuauaucuguuaugaaaucagggugcaugcacugucagagagccaaggagggugcagcuccauccggggugacuccaagcacaaagcaccagugaguggcccucacauuacugccaucacagagaaaaaggaacgccuuuucauuuccuggacccacauuccauucccggagcaaaggggcugcauccuccauuacagaauauacuggaaagaacgagacucgacagcacaaccugagcucugcgaaauucaguaccgacgcucucaaaacucacauccaauaagcagccuacagcccagggugacauauguccuauggaugacagcugugacagcugcuggugaaaguccccaaggaaaugaaagggaauuuuguccacagggcaaagccaacuggaaagcauucgugauaucaagcauuugcaucgcuaucaucacggugggcacguucucaauucguuacuuccggcaaaaggcauuuacucuccugucuacucucaaaccucaaugguauagcagaaccauuccagauccagcaaacagcacuuggguaaagaaguaucccauucuggaggagaagauccagcuaccuacggauaaucuccugauggcauggcccacuccugaagagccugagccccugaucauccaugaaguccucuaccacaugaucccaguugucagacaaccauauuacuucaaaagaggccaaggauuccaaggcuacucuaccuccaagcaagaugcaauguauauugccaauccacaagcuacaggaacucucacagcugagaccagacaacuagugaaccuauacaaggugcuagaaagcagagacccugacucaaaacuggccaaccugaccagccccuugacagucaccccagugaacuaccuuccuagccaugaaggcuauuuacccuccaacauagaagaucugucaccacaugaggcugacccaacugauucuuuugaccuggagcaucaacauauuucucuuuccauuuuugcaucaaguucucuccgcccacucaucuucgguggugagcggcugacucuagaucgguuaaagaugggcuaugacucccucaugaguaaugaggcuugauacuagaaagccaacguaccucauuuuaucugcccaguuccuacuccaaaggucugugacagugaagacaagccagcugucucuggauaaaguuagcuucaccauagguacuuaagucuuauggauaagguggcaauacaccaacacugauaucauauagaaaggaccccaagauagucaugcuc

SEQ ID NO: 264 - RNA, 2487 nt, Homo sapiens
ggcacgaguucacccucugcaugcguuccccuccccccucuccagcaaacacggcgcgccaguccaaagcggacucaguggccucggggacgggagcaugccaccuccuguggugacgucacuugggguagaacccuuagacacuacaugggggggggggguacagaacucccgagccaggacagucacucacucuucaggcgguggggcugggccagacaguaccgcccccaccgcgcccgccucgcacacccucggaagcgcaggcucgcagcgcggcgcuggggugggggguugcgccccagaacuucggccuccaguccccagcccgcugcaccuccuuacccucuagaggcccccucccccuuacccucuagaggcaccaggaguugucgcaaggggcccuugggaaauucccuggaccccugugccaggaggugcccgguucgcccgcuccccauccacccccccgagggcggugcccgggggcgcugccccauggagcggggaggcgggcgccgucugcugcgggagcugugaccugaguaggagcugugugucgcagccgccccaccccugccgaucaugcgccggcgacccugguucgccagucccacugggcugugagccccccacuccuggccugucacggcccgcgcgccaugggcagcgcccacccucgccccuggcugcggcucccacaagggccccagccgcggccugaguucugggcgcuccuguucuuccuacugcugcuggcugccgcugugcccaggucagcacccaacgacauccugggccuccgccuacccccagagcccgugcucaacgccaacacagugugccugacauugcccggccugagccggcggcagauggaggugugugugcgucacccugacguggccgccucugcuauccagggcauccagaucgccauccaugagugccagcaucaguuccgggaccagcgcuggaacugcuccagccuggagacucggaacaaaguccccuacgagagccccaucuucagccgagguuuucgagagagugcuuucgccuacgccauagcagcugccgggguggugcacgcaguguccaacgcgugcgcucuggguaaacugaaggcuugcgguugcgacgccuccagacguggggacgaagaagcuuuccgucggaagcugcaccgcuugcagcuggacgcgcugcagcgcggaaagggcuugagccacggggucccugaacacccggccauacuuccugccagcccaggucugcaggacuccugggagugggguggcugcaguccggaugugggcuucggagaacgcuucucuaaggacuuucuggacucccgagagccucacagagacauccaugcucgaaugagacuccacaacaaccgugugggccggcaggcggugauggagaacaugcggcguaagugcaaaugccacggcaccucaggcagcugccagcucaagaccugcuggcaggugacgccugaguuccgcacaguaggggcgcugcugcgcaaccgcuuccaccgcgccacgcucauccggccgcacaaccgcaacgguggccagcuggagcccggccccgcgggagcacccucgccagcaccgggcacuccagggcugcgccgcagggccagccacuccgaccuggucuacuuugagaaaucucccgacuucugugagcgcgagccgcgccuggacucggcaggcacugugggccgccugugcaauaagagcagcacgggucccgauggcugcggcagcaugugcuguggccgcggccacaacauucugcgccagacgcgcagcgagcgcugccacugccgguuccacuggugcugcuucguggucugcgaagaaugccgcaucaccgagugggucagcgucugcaagugagcagacccaagcuccucugggucucaagaaugguuguccucuuggugccuggcuucugccgcuagcggaucugagccaggcagcaagcagcagccuuggcuccugagagaggugguuggcucuuacagccccgagggucuacaaucaccagacaguccagaucugauugacauuccuccgcucaccucuguagguuccccucuuucuguuccuagcucagacagcugggggugauaguggagacuguuccacacccuaggacaggucaccaaagcagcccagccuggcaugccuaccuccugucaucucuucuucccuuccccaggagugauaggcaaugcacugaagcugaugggcaccggggaagaaaacuaaaaggcagaaauggccgucaucgggcugaagugacucuaagggcuccagaccucugcuccugucuuucacuuaacagauauuuauuuuugcgcucucuuugagacacucucuggggaaaaagaagcuccggagucuacaggcugauuaagggacauggacaauaaaccaguaaacacacaaaaaaaaaaaaaaaaaa

SEQ ID NO: 265 - RNA, 2093 nt, Homo sapiens
gaauuccgggccgcuugcacuuggcgacuagucugcggcggacgugacgccaaggccacgggcagcgcggguccccugucagaggugucccucgcgcaggaaugggcccgcaggcggcagcuggcaggaugauucugcuggugguccugaugcugucugcgaaggucgggaguggagcuuugacgagcaccgaggauccugagccucccucggugccuguaccgacgaauguucuaauuaagucuuauaacuugaacccugucguaugcugggaauaccagaacaugucacagacuccuauuuuuacuguacagguaaagguguauucggguuccuggacugauuccugcaccaacauuucugaucauuguuguaauaucuaugaacaaauuauguauccugauguaucugccugggccagaguuaaagcuaagguuggacaaaaagaaucugacuaugcacggucaaaagaguuccuuaugugccuaaagggaaaggucgggcccccuggccuggagaucaggaggaagaaggaagaacagcucuccguccucguauuucacccugaagucguugugaauggagagagccagggaaccauguuuggugacgggagcaccuguuacacauucgacuauacuguguauguggagcauaaccggaguggggagauccuacauacgaaacauacggucgaaaaagaagaguguaaugagacucugugugaguuaaacaucucaguauccacacuggauuccagauauuguauuucaguagacggaaucucaucuuucuggcaaguuagaacagaaaaaucgaaagacgucuguaucccuccuuuccaugaugacagaaaggauucaauuuggauucuggugguugcuccucuuaccgucuuuacaguaguuauccugguauuugcguauugguauacuaagaagaauucauucaagagaaaaagcauaauguuaccuaaguccuugcucucugugguaaaaagugccacguuagagacaaaaccugaaucgaaguauucacuugucacaccgcaccagccagcuguccuagagagugagacggugaucugugaagagccccuguccacagugacagcuccagacagccccgaagcagcagaacaggaagaacuuucaaaagaaacaaaggcucuggaggcuggaggaagcacgucugccaugaccccagacagcccuccaacuccgacacaaagacgcagcuuuucccuguuaaguaguaaccagucaggcccuuguagccucaccgccuaucacucccgaaacggcucugacaguggccucgugggaucgggcagcuccauaucggacuuggaaucucucccaaacaacaacucagaaacaaagauggcagagcacgacccuccacccgugagaaaggcccccauggccuccgguuaugacaaaccgcacauguugguggacgugcuuguggauguuggggggaaggagucucucaugggguauagacucacaggagaggcccaggagcuguccuaaggucucccgaggccugcuggugguaaagaaacugaccuuuuaggcaguuuuucugcauugauuucaugaaagaagcuauacauuagcuaauacuaaccacauagaauaucagacuuagauacgugaauaaggauccugugggcacugcuggguccacucugcaaaugccaagacuaucaaaggaacguauugucgcuucuggcuccuucccaggugggcuagcaucugugaguuugccucggcuagccuugcuuccuacagccgccacugcuccuccacccugaucaucucacaggacaggguggaccggguuuuuuuuuuuuuuucacacaccuuuguauauguaaguucauguauauaauauguuuacauguuucacuuugaacugaaagcuacucaaagccagccguaagucuaugguagaaugugauggaacauguugguggaagcuuguacaauagaacacauuggugggagcuuguacauacuuuuuuauggagcauuacuuacgauuuuuuaaguaaaauguuuugaaaccaaaaaaaaaaaaaggaauuc

SEQ ID NO: 266 - RNA, 756 nt, Homo sapiens; identical to SEQ ID NO: 63

SEQ ID NO: 267 - RNA, 181 nt, Homo sapiens
aauucgucgacaugcgccguuccagugcauggugugccaacgcagcuucucccgcuccgaccaccucgcgcugcacaugaagcgccaccagaacugagcgagcgagcgcugccccacccgccugacgccuugcaguccgcucugccauccuuuaaaccgcagaccuaacuucauaaaaaga

SEQ ID NO: 268 - RNA, 2056 nt, Homo sapiens
  misc_feature (1942)..(1943): n is a, c, g, or u
gcuaaacuaucccgcaaagauuuuucuuuccucccuaaacccuccuuuuugcucuccuuuucuauacccuuaacugcaaacaaaccauuaaacgaccccucuccugggccuccgacggcaggaguccgcggaccucccaggccgacagcccucccucuacccgcgagguuccgggccgggcgagagggcgcgagcacagccgaggacauggaggugacugcggaccagccgcgcugggugagccaccaucaccccgcgguccucaacggucagcacccagacacgcaccacccgggccucggccauucguacauggaagcucaguauccgcugacggaagagguggacguacuuuuuaacaucgauggucaaggcaaccacgucccguccuacuacggaaacuccgucagggcuacggugcagagguauccuccgacccaccacgggagccagguaugccgcccgccucugcugcacggaucucugcccuggcuggauggcggcaaagcccugagcagccaccacaccgccucgcccuggaaccucagccccuucuccaagacguccauccaccacggcucuccggggccucuguccguuuacccuccggcuucauccucuucucuggcggccggccacuccaguccucaucucuucaccuucccgcccaccccgccgaaagacgucuccccagacccgucgcuguccaccccgggauccgccgggucggccaggcaagaugagaaagagugccucaaguaucaggugcagcugccagauagcaugaagcuggagacgucucacucucgaggcagcaugaccacccuggguggggccucauccucagcccaccaccccauuaccaccuauccgcccuaugugcccgaguacagcucuggacucuucccacccagcagccugcugggaggauccccuaccggguucggauguaagucgaggcccaaggcacgauccagcacagaaggcagggagugugugaacugcggggcaaccucuaccccacuguggcggcgagaugguaccgggcacuaccuuugcaaugccugcggacucuaccauaaaaugaaugggcagaaccggccccuuaucaagcccaagcgaaggcugucggcagcaaggagagcagggacauccugcgcgaacugucagaccaccaccaccacccucuggaggaggaacgcuaauggggacccggucugcaaugccugugggcuguacuacaagcuucauaauauuaacagaccccugacuaugaagaaagaaggcauccagacccgaaaccggaagaugucuagcaaaucgaaaaagugcaaaaaggugcaugacgcgcuggaggacuuccccaagagcagcuccuucaacccggccgcucucuccagacacaugucaucccugagccacaucucucccuucagccacuccagccacaugcugaccacaccgacgcccaugcauccgcccuccggccucuccuucggaccucaccacccuuccagcauggucaccgccauggguuagagaggcagagcccugcuccacaugcgugaggagucuccaagugugcgaagaguuccuccgaccccuucuacuugcguuuuucgcaggagcaguaucaugaagcccgaaagcgacagaucuguguuuuugaaggcagaaagcaaaauguuugcuucuuuuuucaaaggagcucgagguggugucugcauuccaaccacugaauccggaucccauuugugaauaagccauucagacucauauucccuauuuaacagggucucuagugcugugaaaaaaauauugcugaacauugcauauaacuuauauuguaagaaauacuguacauuugaggaagacuuuauuguaccuggauagcuguaagaaaggcaugaaggacgccaagaguuuuaaggaauauaggggnnuuaaaguauggagauacagaagaaaccacuaagucugauguccaaaugggcacacugucaguuuuguuucccuucaguuguuugaugcauuuaaaaaaaaaaaaaagaaagaa

SEQ ID NO: 269 - RNA, 1508 nt, Homo sapiens; identical to SEQ ID NO: 10

SEQ ID NO: 270 - RNA, 9471 nt, Homo sapiens
  misc_feature (121)..(121): n is a, c, g, or u
agucaccgacguuguauaacgacggccagugaauuguaauacgacucacuauagggcgaauuggguaccggccccccccucgaggucgacgguaucgauaagcuugauaucgaauucucgnccgcgugcgggucuggucggggcggagcgaaggccgcggguggccguggucgguccuccgcggcuaaggagccgagggcuccgacgcgggcugcgcccggugagcggcggccagagcuaacuugcgcugacuggaccagcugaggagcggcccggcggggcgacugcgagcuucaccgagaggcuucuccgcccugguccgcagucccgacggccgggcggaccauggcguccucggcucaccuggucaccaucaagcggagcggcgaugacggcgcacacuucccgcugagccucagcuccugccuguuuggaaggaguauugaaugugacauucguauccagcugccuguagugucucaaagacauugcccaauuguaguccaagagcaagaggcgauauuauauaauuucaguucuaccaauccaacucaaguaaacgggguuacuauagaugagccugugaggcugagacauggagacauaauaaccaucauugaccgcuccuuuagguaugaagauggaaaucaugaggauggaagcaaaccaacagaauuuccaggaaagucccuuggaaaggaaccaucaaggcgagccucaagagauagcuucugugcugacccugauggggaaggucaagauaccaaagcuucaaaaaugacugcuucaagaagaucuuuuguguaugccaagggccuuucugcagauagcccugccucagauggcucaaagaacaguguuagccaagacucaucagggcauguagaacagcacacuggcagaaacauaguagagcccacuucugggggaucucuuuuaagaaguccaggucuacagggagcaguuacagggaaccgaagucuucuuccuacacagagccuuagcaauagcaacgaaaaggaaucucccuuugagaaacuuuaucaaucaaugaaggaagaguuggauguaaaaucccagaaaucuuguaggaaaucagaaccccaaccugaccgugcagcagaggaaucgcgggagacacagcuauuggugucaggcagggcaagagcaaagucuaguggaagcaccccuguuacugcagccucuucacccaaaguaggaaagaucuggacugagagauggcgcgguggaauggugccuguccagacuuccacagagacagcuaaaaugaagaccccugugcggcauucacagcaacuuaaggaugaagacucucguguuacuggcagacgacauucugugaaucuggaugaagguggaagugcccaggcaguccauaaaacagucacuccugggaaacuggcgacuagaaaccaaacuccgguggaggcuggggauguuggcagccccgcugauacaccagaacauuccucuuccccccagagaaguauuccugcaaagguagaggcuccaucugcagagacacaaaaucggcucucuuuaacucagcgccuuguuccaggugaaaagaaaacucccaaggguuccuucagcaagccugagaaacuggccacagccgccgaacagacuugcucuggccuaccuggucuuaguuccguugauaucagcaacuuuggugauuccauuaacaagagugagggaaugccuaugaagagaagacguguauccuuugguggacaucuaagaccugaauuauuugaugaaaacuugccuccuaauacaccacugaaaagaggagaaacgccaaccaagaggaagucucuuggcacucacagcccagcuguccucaagacaaucaucaaggaacggccccagucuccagggaaacaagagucuccugggauaacgccaccgaggacaaaugaucaaagacgcagaucaggcaggacuuccaguggaagcaauuucuuaugugagacagacauucccaagaaagcaggcaggaagagcgguaaccugccugcgaagagagcauccaucagccggagucagcauggcauucuacagaugauuugcuccaaaaggcgaaguggagcuucugaagccaacuugauuguugcaaaaucaugggcugauguuguaaaacuuggcgugaaacaaacacaaacgaaaguugcgaaacaugucccuccaaagcagacgagcaagagacaaagaagacccagcacuccaaagaaacccacaagcaaucuucacaaucaauuuacuacaggccaugcaaacucucccuguaccauuguaguagguagagcgcagauugaaaaaguaagugugccugcccgacccuacaaaaugcugaauaacuugaugcuaaaccgaaaaguggacuucagugaagaucugucaggacuaacugaaauguucaagacuccagugaaggagaagcagcagcagaugagugauacaggcuccguacuuuccaauucagcgaauuugucugaaagacaauugcaaguaacuaauucaggagacauaccugagcccaucaccacagagauuuugggagaaaaagugcuauccaguacucggaaugcagcaaagcagcagucugauagauauucugcaaguccuaccuuaagacggcggagcaucaaacaugaaaacacagugcaaacuccuaagaauguccauaacauuacugaccuugagaagaagacuccggucucugagacagagccccugaagacugcaucgagugugagcaaguuaagaagaucuagagagcucagacauacccuuguggaaacuaugaaugaaaaaacagaagcaguccuugcugagaacaccacagcaagacauuuaagggggacauuucgagaacaaaaaguagaucaacaggugcaggacaaugaaaacgcuccucaaagaugcaaggaaaguggugaauuaagugaagguucagaaaagacaucagcuaggagaucaagugccaggaagcagaagccgacaaaagacuuacuaggaagucagauggucacccaaacagcagacuaugcugaggaacuacuuagucaaggacaaggaaccauacaaaaccuagaggaauccaugcacaugcaaaacacaucaauaagugaggaucaaggaauuacagaaaagaaagugaacauaauaguauaugcaaccaaagagaagcacucgccaaagaccccuggcaaaaaggcacaaccucuagaagggccagcuggucucaaggaacacuuugaaacaccaaaccccaaagauaaaccuauaacggaagacagaacuagaguccuuugcaaaucaccacaagucacaacagagaauaucacaacaaacacaaagccacagacuagcacaucugggaagaaaguagacaugaaggaagaaagcucugccuugacaaaacguauacauaugccaggggaauccaggcauaaucccaaaauuuuaaaacuugagugugaggauaucaaagcuuugaagcaaucugaaaaugaaaugcugaccucaacaguaaauggaagcaagaggacuuuaggaaaaucuaaaaaaaaggcucagccccuggaagaccugacuuguuuccaggaacucuuuauaucaccaguuccuacuaacauaaucaaaaaaauucccagcaaaucuccacacacacaaccagucagaaccccagcgagcacaaagagacucuccaagacaggucucaguaaaguggaugugagacaagaaccuucaacacuugggaaaagaacgaagucaccaggcagagccccaggcacaccagcaccagugcaggaagaaaaugacugcacagccuacauggaaacuccaaagcagaaacuggagucuauagaaaauuuaacagggcuuaggaaacaguccagaacaccuaaagacaucacugguuuccaggauaguuuccaaauaccagaucaugcuaauggcccauuagugguugucaaaaccaaaaaaauguucuuuaauucuccacaaccagaaagugccauaacccgaaagagcagagagagacagucuagggcaaguauaaguaaaauagauguuaaagaagaacuuuuagaaucagaggaacaccuacaauuaggagaagguguagacacauuucagguauccaccaacaaagucauuagaucaucuaggaaaccugcaaagcguaaacuggauucaacagcugguaugccuaacagcaagaggaugcgcuguucuucaaaggauaacacaccaugccuagaagaccugaauggcuuccaagagcucuuccaaaugccaggcuaugcuaaugacucuuugaccacuggaaucucaacaaugcuugcuagaucaccacaauuaggaccaguuagaacccaaaucaacaaaaagagucugcccaagaucaucuugagaaaaauggaugugacagaagaaauuucaggucucuggaagcagucacugggcagaguccacaccacacaagagcaggaggauaaugcaaucaaagcaauuauggagauuccaaaggaaacacugcagacugcagcagauggaacuaggcuuaccagacagccacaaacaccuaaggaaaaaguucaaccgcuggaagaucacagugucuuccaagaacucuuccaaacaucacgcuacuguucugauccauuaauugguaacaaacaaacaagaauguccuugagaucuccacaaccaggauuuguuagaacuccacgaaccucaaagagacuggcuaagacaaguguugggaauauugcugugagagaaaagaucucuccagugagucugccacagugugcuacaggggagguuguacacauacccauagggccagaagaugacacagagaacaaaggugugaaggaauccacaccucagacacuggacucaucagcaagucgaacugucagcaagaggcagcaaggggcacaugaggaaaggccucaguucucaggagacuuauuucauccccaagagcucuuucaaacaccagccaguggcaaagacccaguaacuguugaugaaacuacaaaaauagcucugcagucuccacaaccaggacauaucauaaacccagcaagcaugaagagacaguccaacaugagucucaggaaagacaugagagaauuuuccauacuugaaaaacaaacacagucacgaggcagagacgcaggcacaccagcaccaaugcaggaagaaaauggcaccacagccauuauggaaacaccaaagcagaaacuggauuucauaggaaauucaacaggacauaagaggaggccucggacacccaaaaacagggcucagccccuagaagaccuggauggcuuccaagaacucuuucaaacaccagcuggugccagugacccugugaguguugaagaaagugcaaagauaucuuuggcaucuucacaagcagaaccagucagaaccccagcaaguacaaagagacgcuccaagacaggucucaguaaaguggaugugagacaagaaccuucaacacuugggaaaagaaugaagucacuaggcagagccccaggcacaccagcaccagugcaggaagaaaaugacagcacagccuucauggaaacuccaaagcagaaacuggauuucacaggaaauucaucaggacauaagaggaggccacagacaccuaagaucagggcucagccccuagaagaccuggauggcuuccaagaacucuuccaaacaccagcuggugccaaugacucagugacuguugaggaaaguguaaagaugucuuuggaaucuucacaagcagaaccagucaaaaccccggcaagcacaaagagacucuccaagacaggucucaguaagguggaugugagagaagacccuucaauacuugagaaaaaaacaaagucaccaggcacaccagcaccagugcaggaagaaaaugacugcacagccuucauggaaacuccaaagcagaaacuggauuucacaggaaauucaucaggacauaagaggaggccacggacaccuaagaucagagcucagccccuagaagaccuggauggcuuccaagaacucuuccaaacaccagcuggugcuagugacucagugacuguugaggaaagugcaaagaugucuuuggaaucuucacaagcaaaaccagucaaaaccccggcaagcacaaagagacucuccaagacaggucucaguaagguggaugugagagaagacccuucaacacuugggaaaaaaacaaagucaccaggcagagccccaggcacaccagcaccagugcaggaagaaaaugacagcacagccuucauggaaacuccaaagcagaaacuggauuuugcagagaauucaucagggaguaagagaaggucacgaacaucuaagaacaggucucagccccuagaagaccuggauggcuuccaagaacucuuccaaacaccagcuggugccaguaacccugugaguguugaagaaagugcaaagauaucuuuggaaucuucacaagcagaaccagucagaacccgggcaagcacaaagagacuuuccaagacaggucucaauaagauggaugugagagaagggcacucuccgcucaguaagucaagcugugcaucacagaaagucaugcaaacccucacacuuggagaagaucauggcagagagaccaaagaugggaagguauuguuagcucagaaauuggaaccagcaauauauguuacucguggcaagaggcagcaaaggucauguaagaaaaggucccaguccccagaagaccucucugguguucaggaggucuuccaaacaucaggccauaacaaggauucagugacaguggacaaucuugcaaaacugcccagcucgucuccaccacuagagccaacagacacuucaguaaccucacggagacaggccagaacuggucugaggaaaguucacgugaaaaaugaacuuucaggaggcauaaugcauccacaaauaucaggggaaauuguggacuuaccuagagaaccagaaggugaaggcaaagucauuaaaacaaggaagcaaucuguaaaacggaaauuggacacagaagucaaugugccucgcaguaagaggcaaagaauuacaagagcagaaaagacccuagaggaucugccuggcuuccaagagcucugccaagcuccaagcuugguaauggacucaguuauuguugagaaaaccccaaagaugcccgacaaaucuccagaaccuguggauacaacuucagagacacaggcaagaagaagacucaggagacugguuguuacugaagagcccauaccacaaagaaagacuacaagaguuguaaggcaaaccagaaacacacagaaagagcccauaagugacaaucaagguauggaagaguuuaaggaaucuucaguacagaaacaagacccaaguguaaguuuaacuggcaggaggaaccaaccaaggacaguuaaggagaaaacccaacccuuagaagaacucaccaguuuccaagaggaaacugccaaaagaauaucuuccaaaucuccacaaccggaagagaaggaaaccuuagcagguuuaaagaggcagcucagaauacaacuaaucaacgaugguguaaaagaagagcccacagcacagagaaagcaaccauccagggaaaccaggaacacacucaaagagccuguaggugacaguauaaauguugaagagguuaagaagucuacaaagcagaaaauugauccaguagcaagugugccugucagcaagaggccacggaggguacccaaggaaaaggcacaggcccuagaauuggcuggucucaaaggaccaauccaaacccuaggccacacugaugaaucagcaagugauaaaggacccacacagaugcccuguaauucucuacaaccagagcaaguugacagcuuccaaagcucaccaaggcgacccaggacaagacgugggaaaguagaggcagaugaagagccuucagcaguaagaaagacaguaucaacaucaaggcaaacuaugcgaucccgcaaggucccugaaauugguaacaaugguacccaaguuucaaaggccuccauaaagcagacauuagauacaguagccaaaguaacuggcagcaggaggcagcuaaggacacauaaaggaugggguucaacccucuugaaguuguuaggugacuccaaagaaauaacccaaauaucagaucacucugagaaacuagcacaugacaccaguauccuuaagagcacucaacagcaaaagccagacucaguaaaaccucugagaacaugcagaagagugcugagggccucuaaagagguccccaaggaaguguugguggacaccagagaccaugcaacauuacaaagcaaaagcaacccuuugcuguccccgaagaggaagucugcaagagauggaagcauugugagaaccagggcuuugcgcucuuuagcaccaaagcaggaagcaacagaugagaagccuguaccugagaaaaaaagggcugcuuccagcaagagguauguaucaccugagccugugaagaugaaacaccugaaaaucgugucaaacaaacuugaaucuguggaagagcagguuagcacuguuaugaaaacagaagaaauggaagccaaaagagaaaauccugucacuccagaucagaacucuagguaccgaaagaaaaccaauguaaaacagccaaggcccaaguuugaugcaucugcagagaaugucgggauaaagaaaaacgagaagacuaugaagacugccucccaggagacagagcugcagaauccagaugauggagccaagaaaucuacaucucggggccaagucagugggaaaagaacaugcuugaggucuagaggaacgacugagaugccccagccuugugaagcagaagagaaaacaagcaaaccagcugcagaaaucuugauaaagccucaggaagagaaaggagucucuggagagucugauguuagguguuugagguccagaaaaacuagagucgcuuuggacagugaaccuaagccaaggguaacucguggaaccaagaaagaugcaaaaacucugaaggaggaugaagacauuguaugcaccaagaaguuaagaacaagaaguuaagaacaagaaguuaccagaaaagugaaacuauguagcaaagacauuuaagaaggaaaaguaaauuugacuuagugauaaguuccagugugguuuucaccuccaguguaaagaugaacuguaaauacuacugcuacugccugaguuuaaggaaggaagcuuugagcuuuccuggucauacucucuucagacgccaauggaggucaugaggaagaucaccagggaucucagcgcaauuacaguuuaggggugagcaggcagaaauguggcccucuguccuauccaauaaagcucugaaauucgcugccaaaa

SEQ ID NO: 271 - RNA, 463 nt, Homo sapiens; identical to SEQ ID NO: 4

SEQ ID NO: 272 - RNA, 1280 nt, Homo sapiens
cuacccuagacaaucacggcuuagccggcgcgcggagucgaucgucucggucgcuagagcuguccugagcucgaacgguccgacgcccccgccgcgccgguccgugacgccggggccgacacgaugaaggauuugggggccaagcacuuggcagguggcgaagggguucagcuuuucggauuguugaacuucuaccuggaacaagaacagagauaccaaccucgggaaaaagggcugaucuugauggaggcuaccccggagaaugauaacacuuuguguucaagacugagaaaugccaaaguggaagauuuaagaaguuuaacuaacuucuuuggaucuggcacugaaacuuucguucuggcugucaauauuuuggauagauucuuggcccuuaugaaggugaaaccgaaacaccuguccugcauuggcgucugcugcuuuuugcuggccgccaggcuggcggaagaagaaggugacguuccccccacgcacgacgugauccgcaucagucaguguaaaugcacagcgucugacauuaaacgcauggagaaaaucaucucagagaaacugcacuaugagcuggaagcuaccacugccuuaaacuuuuugcacuuguaccacgcgauuguauuuugucacacuucagaaaggaaggagauucucagccucgauaaacucgaagcgcagcugaaagcuugcaacugccgaguugucuucuccaaagcaagaccaucuguauuagcucugugccuucucaauuuggaaauagaaacgauaaaauccguggaacugcuggaaauucucuugcuuguuaaaaaacauuugaagcucagcgacacugaauucuuuuacuggagggaacugguuucuaaaugucuagcagaguauucuucgccucgcugcugcaagccugaucugaagaagcugguauggauuguuucgcgacgcacugcgcagaaccuccacagcagcuacuacaguguuccugagcugcccacuaucccagagggggguugcuuugacggaagugaaagugaggacucuggugaagacaugaguuguggagaggagagucucagcagcuccccacccagcgaucaggagugcaccuucuucuuugacuuccaaguggcucagacacugugcuuuccaccauagaggaaucugacauuguucugugucagggaauuuauaaguguguguaccuagguuucaaagcaauaaacuuggggguugaauaggguaguuuuccuagguuuccagccccccgucuagucagg

SEQ ID NO: 273 - RNA, 291 nt, Homo sapiens
aacuaccuugggcagguucuauuaacugcaccuaacucagacgugaguaggacagaaggaagcugucccgggcgaacugaggucacaaagacuugcuuuugauucaagagagaccuuaaaggcuaguuaugauaguuaaguacaaguuuuaacaucugguagcuaacuuuuuuucucuaccccguaauucuacuaugacugcucuucuagagguccugaguucaaaucccagcaaccacaugguggcucacaaccaucuauaaugggaucugaugcccucuucuggugugc

What is claimed is:

1. A method for treating baldness in a human subject comprising wounding an area of the balding scalp of said human subject by disrupting an epidermis or dermis of the area of the balding scalp, wherein said wounding step comprises disrupting the basal and suprabasal epidermal layers of the balding scalp.

2. The method of claim 1, wherein said wounding is dermabrasion.

3. The method of claim 1, wherein said wounding is performed with a tool that comprises sandpaper, a laser, a Fraxel laser, a CO2 laser, an excimer laser, a felt wheel, a dermabrasion device, a light-based method, irradiation with visible light, irradiation with infrared light, irradiation with ultraviolet radiation, orthovoltage radiation, x-ray radiation, a surgical tool, a dermal biopsy punch, or is performed with a burn treatment or chemical treatment.

4. The method of claim 3, wherein said dermabrasion device is a micro-dermabrasion device.

5. The method of claim 1 or 3, wherein the wounding-step comprises disrupting the epidermis and dermis of the area of the balding scalp.

6. The method of claim 1 or 3, in which only part of the epidermis is removed.

7. The method of claim 3, wherein the wounding-step comprises contacting a precursor cell with an inductive cell.

8. The method of claim 3, wherein the method further comprises contacting said area of the balding scalp with a precursor cell, an inductive cell, or a hair follicle or a portion thereof.

9. The method of claim 3, wherein the method further comprises contacting said area of the balding scalp with one or more of the following compounds: minoxidil, finasteride, dutasteride, fluridil, spironolactone, cyproterone acetate, bicalutamide, flutamide, nilutamide, an inhibitor of an androgen receptor, an androgen antagonist, or an anti-androgen.

10. The method of claim 9, wherein the compound is administered as a cream, gel, lotion, emulsion, suspension, oil, non-aqueous solution, aqueous solution, or drop, or by direct injection, or is encapsulated in a liposome.

11. The method of claim 9, wherein said wounding-step is performed between 3-12 days, 4-12 days, 5-12 days, 4-11 days, 6-11 days, 6-10 days, 6-9 days, 6-8 days, 7-8 days, 5-11 days, 5-10 days, 7-10 days, or about 1 week prior to said contacting step.

12. The method of claim 3 or 9, wherein said area of the balding scalp is subjected to depilation or administration of a retinoid prior to said wounding.

13. The method of claim 12, wherein said depilation is performed by plucking, waxing, abrasion, laser, electrolysis, or administration of thioglycolic acid on said area of the balding scalp.

14. The method of claim 3 or 9, wherein said wounded area of the balding scalp is not surgically closed, or not contacted with a bandage, dressing, or ointment that facilitates wound healing for a period of time following said wounding-step.

15. The method of claim 14, wherein said period of time is within about 1 day, about 2 days, about 3 days, about 4 days, about 5 days, about 7 days, about 10 days, about 11 days, about 14 days, about 17 days, or about 3 weeks.

16. The method of claim 14, wherein said wounded area of the balding scalp is allowed to heal by secondary intention.

17. The method of claim 3 or 9, wherein said wounded area of the balding scalp is allowed to heal by secondary intention.

18. The method of claim 3 or 9, wherein said wounded area of the balding scalp is contacted with a gel, cream, lotion, emulsion, suspension, oil, non-aqueous solution, aqueous solution, or drop following said wounding-step.

19. The method of claim 18, wherein said contacting-step is within about 1 day, about 2 days, about 3 days, about 4 days, about 5 days, about 7 days, about 10 days, about 11 days, about 14 days, about 17 days, or about 3 weeks of said wounding-step.

20. The method of claim 3, wherein the method is performed on a subject with androgenetic alopecia (AGA), scarring alopecia, male pattern baldness, female pattern baldness, discoid lupus erythematosis, or lichen planopilaris.

21. The method of claim 3, wherein said treatment results in an increase in markers of hair follicle proliferation, hair follicle differentiation or hair follicle embryonic development.

22. The method of claim 3, wherein said treatment results in an increase in the amount of pigmented hair or an increase in hair follicle size.

23. The method of claim 3, wherein said treatment results in differentiation of an uncommitted epidermal cell into a hair follicle cell.

24. The method of claim 3, wherein said treatment results in generation of a hair follicle in the scalp of the subject.

25. The method of claim 3, wherein said wounding does not result in bleeding.

26. A method for treating baldness in a human subject comprising perforating an area of the balding scalp of said human subject by disrupting the basal and suprabasal epidermal layers of the balding scalp, thereby disrupting an epidermis or dermis of the area of the balding scalp.

27. The method of claim 26, wherein said perforating-step is performed on a scarred region of the scalp.

28. The method of claim 26, wherein said perforating-step does not result in bleeding.

29. The method of claim 26, wherein the method further comprises contacting said area of the balding scalp with one or more of the following compounds: minoxidil, finasteride, dutasteride, fluridil, spironolactone, cyproterone acetate, bicalutamide, flutamide, nilutamide, an inhibitor of an androgen receptor, an androgen antagonist, or an anti-androgen.

30. The method of claim 29, wherein said perforating-step is performed between 3-12 days, 4-12 days, 5-12 days, 4-11 days, 6-11 days, 6-10 days, 6-9 days, 6-8 days, 7-8 days, 5-11 days, 5-10 days, 7-10 days, or about 1 week prior to said contacting step.

31. A method for treating baldness in a human subject comprising contacting an area of the balding scalp of said human subject with a rotating wheel thereby disrupting an epidermis or dermis of the area of the balding scalp, wherein said disruption comprises disrupting the basal and suprabasal epidermal layers of the balding scalp.

32. The method of claim 31, wherein said contacting-step does not result in bleeding.

33. The method of claim 31, wherein the method further comprises contacting said area of the balding scalp with one or more of the following compounds: minoxidil, finasteride, dutasteride, fluridil, spironolactone, cyproterone acetate, bicalutamide, flutamide, nilutamide, an inhibitor of an androgen receptor, an androgen antagonist, or an anti-androgen.

* * * * *